United States Patent 12,734,201 (PROBIOTIC COMPOSITION FOR THE TREATMENT OF COVID-19) - sequence listing, part 2

SEQ ID NO: 5 - DNA, 3237983 bp, Lactobacillus plantarum (residues 1,618,993-3,237,983 of 3,237,983)
tattaccatttaaattataatcaatcttatgcttacgtcaactattatgcagccagctgacattgacagatacaattagctcccaataattaaattatcatttattagactaacggcaatgacaatgttacccttaaattgtcaacgacattatataagtattttgaaggagtggggatctttgaaaccaaacaatgttaataatcagaataaacgtcaccaatcgcgatgggtaatcacgagcgcaaccgccatgatactgacaacgttaacgattgccagtcaggcggcggctgccgacgatacagtcacgaccacaaccaacgaaccgaccaacagtcagttgaatacgaatactcaagttaacgctactcaggtcaatttgaaagcggatacttctacatcagtatccacgataaaatccgaccagtcagcagtcgcagccacgtcacccaccacatcaaccggaagtccctctgagcactcgtcgtcagtgaacaccaacccacaacaacaatcagcaaatccagcatcacaatctcaagcaactaccacgtcagaatcaacaccgaccacagatattaagcacccaactcaaaccgcaccagctcaaacaacctccgcatcaactactgaaccaactaccgaatcaaacactgaatcagcgactgatagtcaagctaaagcaacgacaaccgataatcaagcttccaagcaaccaagccagcaagccgcacccgcgccgtccaactccactaccaccgaggtgaatactcagtcagcgactagctcagcgtcaaccgatgataaaattgttaccaatgtaaaccaggaaaagctagttttgaaaactaaccaaccagtcgtccgtgccattagccgcaccgcgtcagaaaatattaacgattggatgccaaacacattattgcaacaagaggtactcagtcaactgcgcaaacagaacccagatcgtacctggaactcagctgcagacatcactaaggcagatatgctactactgaccacctactatggcaaggacacttatatcgacggcaagacttcctactcattagaaggactgcaatatgccactaaccttacgacagtctggctcaacaacaacttgaacgcaccgtctggcagttactatagtgatgtcactgatatttcaccattagccaacttacaaaaactccaagtggtcaatattcagcaaaaccggatcacggacatttcaccgctcgcaaacttaaagaatttaacggaggtcgatgccgcctataaccacatttcagatttttcgccacttaaaggatttaaaaatctgaaaggcacattcagtaaccaatttatcaccttaccacccgcctatattagtgcagataataatattgcgacgctggcgattgattgctatttgccagatggctctaaagttcaactgaagcccaataatggcgtcggtgaaactgttttctacaaaaacggtcagctttacgttcgctggtactttaacggtgcgggcggtggtaattacgacagcaacggtcatatctactacacgaatatgaagccccagcaacccggactaacaggtccgacctttaacggtaccacggttattcccatggacgattattatttcatgactgccgcttctgacggtaacaactttgtcgtcgtccgcccgtatgtcttagctgccactgctgcgcccatcacggtcaaatacgtcgacgcgcttaccggtgaatccttagtcaccgctgacctcaccttaaacggaatcgtcggtcagccttacacgactcagcgcattgatgacgagctaccaaattatgactttacgaacattgtcggcaatgccagtggtgtcttcacagcggatgcccagaccgtcacttattactatactcgtaaggacgccggcgacattacgattcacatggtcgatgctaacggcaacttagtctacgaaccgcaaattctacctggaaaacacaatctcggtaacgcctacaatttagatgcgccaacctttgaccattttaaattacagcaaactatcggcaatgcggctggcgttttcacgactgatccgcaaagcatcacgtttgtctatgtccgcttagacgccggtaacattacggtgaaatatcaagataagcagggaaaacaattaaagcccgataagacaatttccggctcccaatcactcggccaagcctatacgactgaaccgttggatattgaaaattacaccctgacgacaacgccgacaaacgccacgggcactttcacagaccaggaacagacggtcatttacgtctatgtgcgccgcgatgctggccagatcgttgttaagtatcaagatagtgctggtaacccactagcacccgacaagcttttagacggtaaagaacagctaggagcagcctatcaaacggaagccatttcaattcctaacttttacctagtcgccacacctgcgaacgccaccgggaccttttcaaccgacgcgcaaaccgttatttaccagtatacgcgctcgaatgctggccatatcacggtgaagtatcaagacgctaacggcacgaccttagctcccgacgacgtcctaactggtgacggtcagctcggtcgcccctatcagactagcgccaagacgattgaaaactaccgcttaattcaaacgccggcgaacgctactgggcaattcagcgaccaagcgcaaaccgtcatctacgtctacactcgcgaggatgcgggtgacatcacggttcagtatttagacgaaaacggccagcagttagccgccgatagcgtattaagcggtcaaggtcaattaggacggccctatgaaacgtcaccgctgaacattaacggctatacggtaaaatcgacacagggtaacacgactgggacctatactgtacagccgcaacgcgtcgtttacatttacgatcagacagctggacagccggtcactgccaagtatcaggaccaagatggtaagtctatccatcctgacgttgttcacagcgggtatttgggtgacaactactcgaccgaacaacttgttatcgacggctacacctttaaagccgttcagggtgacgtcagtgggacgttcgggacttctgctaagactgtgacctacgtctatgaacggacggctgggctacccgtcactgccaagtatctggatgagcatggtaagtctatccatcctgacgttgttcacagcgggtatttaggtgacagctactcgactgaacagctggttatcgatggttacaccttcaaggctgtgcagggtgacgtcagtgggacgttcgggaactaccgcgaagactgtgacctatgtttacactgtaaacacccccacaattccagatacccaaggaaccgttacggtgcattacatgaccaaggacggcattaaactaaacgaaccaaccgtgctgagcggcaagacgggaaccacttatcaaaccgtgcccctgacgttcactgatcatgaactcgttggtcagccggaaaatgccatgggtctcttcactgctgataacgtagacgtcacgtacgtctaccaagcaactgacacgactggtaccgacgatattattgatcccgaagaaccggaacaaccgactaagccgattaagcctgttgagccaaccacacccgagacgcctaacgaaccaggaacgaccgtaacgcagccggatcgcattaagccgactcaaccagcggtagctgtaaaaccagcagcgaccgtgaaaccaacgcttaaacccgcggccgcccaggcaagtttggtcaaaacaacgagtcccgtcactgaacactcagcccagttaccacaaaccaacgaacagactggcaaattagcggtcatcctaggactgttattatccatcgtcacgttcgggttctatggtaaacatcggcaatcataacgtcatcaggtctaacgaaaacgacacttcatttttcgaagtgtcgttttttctgatcaaaggtgcctataatgaaattaataattataattccgatgaaggaagtcctaatcgatgaaagtctatctcattcgtcactccgaaccaacttatcaacaggtcactacagctggattaactggtttcggccgtgaactcggcggcttaaccgaccgtggtattatgctggcacaacaatgcgcccagcagccgttatttgcacaagtccaattaattctgtcgtccccctacacacgcgccttacaaacggcactggaaattgtgcgttttaatgatatcccactaaaggtcgaacttggattacacgagtggctacccgataacacgggtagtcggactgataccgatgaacaagcgaccacggcctacaagctctatcgacaacacgccggcaagcgcaccaccgctagtccccgcccctacgaatcagcagctgaaatgaaggcccgagttttggcaactttgaataagtatgccgcatcttacgattgcatcgcctgcgtcacgcacggcgaggtcatgcagcagtttggcgatcagaaagacgtggattattgtggtgtgcgtgttattgcggttaattgacaattcataagcagtcgccaaacaatggtcgcctataatgaactatcaaccactgtcaatctaataataatcaggcttaaaaactgcgaagtagaaacgattaatcatttgacatgtttaccctggcctcacaataataatattcatttaataattatcataaacatctagcaactaccgtctcaatacaacttaacttttggcacttaataaattaaattgtaagttagcctcttcattactattgtgttttcctctccgtatcccaatgtcttgattgattgattttcattttttgagcaacaatctcaaatggatcaacctgtagcttttcacacatataaaatatataaattaacgtgtcagctaattcttcttgcaaatgttgattttctctattatccaacttctgattagcattatgccactgaaaaatttccaaaacttcactagactcaatgtttagagaaattgccaaatccttcaagttatgatacttctgccagccttttttattacggaattcgattaatgcttgttctatctccgaataattcaattaaatcacctcaaaatatgttgatttccagctgcccttagtaaggcctgttgtagttcctcatcgacagcaaaaatatataacccatggacaccacgagttaataaaacatttagttcgttacgtaacaattcttcggaaacgtcaattttttgatgtttccatgttcgttgattcgtggcttttttattcttactagcttgtttatcaaaaattaactttccgtctcgatacttcactgatgggccgataatcacaccagcataattcaaatcaaaaccttggattgtaaatgttgagccgacctcattaattgtttgaaactgttcggcccaagctagccctttgtttcttcgcttttcttggcgagaaataggaatctgcaaattccatggcaaactccacgtcccaatctttactcgccaacagtcaccatcttttggttttcgtttctcaacatatggccaatcaaacgttgccaacattctggcaagactagcaccgttactatttttcaatcgatctagtgccttgattttagcgtgtagtttttccggagatgtcgcgattttaagttgatattgtgcatcatctggaattacattaatgcgcccatcaattgcaaaatttcgtaaccagtcaatagtacgctgctcggcaatcattcgttcctgatgtgttagctcaattcgattgccttcacgttcagcatcatcttccaattttcgaacagccatgtcgtccaagtatccctcggtagttagtatttgatacttatcaaacacaataactaccactttggctaactttaataaatcctctagctgattatgtccccgatatgccatctttccctgagtcaggagtaaatgagcttcatcaactagtacaacatcaacttttgccgcaccagtatgtttctgaataaaatgagtaggtttggagacgatgtctttatgttcgtgatccaaacctaatttatgtgcaatcgttttataaactgttttttgttgatcgtgattaactaataaatatactgaatctttccgcactaaactactattcgttaagtcgtaaaacaaattactcaacaacacggttttaccagttcctgcctgaccggcaataaagattgtcttaccgcgttccgtagatgattccttcagtgcagactcgatttgaccaaaaatctcattcttactttcatgctgttcagcatttaaagagtggaaaggtgacgctttgaacacagcagaattttcaatttctgatttttccggaaaaatctcaggcttttttttcctaagcgtttgccagactccttcaaacacattctcaaactgatccgacataaagtattttcgctgcggatttgagcgtcgattattcaattgagtaacactctccgcacttaataaatacatcatcaatttattttcaatgtcgagcgttagggatttgttaaaataatagtccccaattacaatcatctgtgaattatgactctcatttaatgctttccaatccatccgtgactttccagtatcttttaaatgctgtcgtgttcttctacttatgtcgttagtttctccaacataaactttgaacttagggtcattactactgcggccagaacctaatttatcataaattaaatagactgtcggatattcaaatatcagctctctattctgcatatctctatgtaggctaacattataaccagtattatatggaacaatttctacaaccggctcaatgtcgccaatgttttcttcaattttgttgtatcgcatatcttcatcctcgtgttaaaaaatctatctggctttattatacatgaaagatcaagggacaaaagagcttaccgcacaaactaaaaaggtagcccgcgctgaaacgtccagcaccgaactacctttataacgaatattaacttattttacaacttccgcgaccgccgcattcaccgcatcacgttcatcttcaactaaggcaacgcgactggcgattaccttagtatccatcttaatttcacgcgttaaaccgggcgtattgatttttggttcaaagaacgccttgaattctgctaaacgttcagccgtatggaagacccgggaaatgacggtgatgtaagtggtaaattccatgtcaccaccaaccgtggcttccaaccatgaccattcgtcgcgaatccaatcccaagctgcttgttcaccagctggattagccaagacgccgcggaaccaggcccgcaagtcttgtggcttaatcgtatcagcatcttcaaacttcacaactaactgtttgattaattcggggtccgtagttgcggtcaatgcgtcacaaatgtcagccttgtaactagcatcggctgtttgccgtgacgccgtcaataaactatcgaataagtccttgctaccaaagttcttgacttcattccgtaaaatgaagacccgcacatcggctggtaaggtcgctaacttatcacgattaccttcgaataactcatgggcagctaatacggccgcgctattcttggcgtacaaagccgcgctcaagacgtatggccgcgtcaactgatcatcgttagattcaccagcttgtggcaaccaccctaaccgtttaacctgagcggcactcaattggtcaaataacgtttgtaaatgcttttcttcatcagaatctggcgtaacaaacttacgtaagttacccgcaacttggtacaacgctgcgttaacgaccgttgaatggctggctgcaaaccggcttaataatggcacaacggctgcgtatgagatttgacgaccttcagctaataagcgtaagtcttgtaacaactgtaactggtcaatggccgttaagtcatcaacgtgcgctagaatatcatccaataacgtttggtcatacttgacgatgaagtgggagttattcccaacgttcaagcgaaatggttgcccactcgcatcacgtaatttagcataatcgccgaccgtcacagcttggtccttcataatcgctggtgccgcctcatagttgctattcaacggaatctgccattgacgaccgacttcttcaccttcaccgatgaagaactgttgttgtgacaaggtcaactgaccgtcaacaaccgctgccgtgaccactggatagccaggttgttccagccatgaatgcatgatgtctccaacttgcatcccagaagcatccgctaaggcgttccacaagtcatcacccttggcattaccatatttatgattgataaagtactgcttcaagcctgctcgtaaggcatcatcaccaactaaggcccgcgccattactaacatccgcgcacccttagcgtagacaatcgcaccgtcaaaaatcgagtcgatttcggccggatcttccacctgaacgtggactgactgaaccccatccgtggcatcccgttgaagcgccattgatgcttcggacgtttggaaagtttcccaaatatgccagtctggttctaaggcgtccgtcgccacatattccatcatgttggcgaaactttcatttaaccagaggtcatcccaccacttcatcgtaaccaaatcaccgaaccattgatgggcaagttcatgggcaatcaccgtggcgacccgttgtttcgtttcgagggccgtgttgtcaggatctaatagtaagtaggcttcccgataagtaactaagccccagttttccatcgcaccagctgagaagtctggtaaggccaattgccatgagtgtggcaatggatatggcgtctgataaaaatcttcataaaattcgattgagcgcttggcaatgtccaaagcaaagtcgagctcgttagccttgtgggccttagtaccgaaaacaccgatggtcacgccactcttggtcttcgtctgcttgccttgtaattcaccaaaggcaaacgcaatcaagtaagtcgacatccgcaccgtggtttcaaagtaatgcactccatcggcttcatgatcttcgggcatgttgcttaagatcgtttcaccatcatgttcatcgtacttgatggcaagatcaaaagtcgctttagcttctggttcatcgacacacggaaaggcttgccgggccgcggtcgtttcaaactgcgtcccgattagttctttcttcacaccgttgacttcgtaatatgatgggtagatacccatcatcgtatccgtcaatttggcactgtacgtaatcgtcaaagttgtttgaccggccttggcaagttcaattcgaattccttgaatcgcattatccacagtaaagggcacgtccgcaccatcggcttggacaccagcaatggtcaaaccattctgatgaatcagcacttcctgcgccttagcatccccggtaatcgttgatttccccgaaatcagcttatccgcccggttaatattgatataaagatcgtaatgttctggttgaaatgtttcgtaaaaatgagttgtggttgccatattattctcctcgttttttaagaatatattcattatacgacaattacgggtggaatgcgtcctctgccgcccatgaatttgtcacgcgactagcaactaattctcgacaacccccatcactaatgatgacacggttccttgcaccgtacgatatcgataatcattagtacgaacgacgatattacgccgcttgtctaaagtcatcgataatttcttcaaactccgcatccgccaacaccggctgccacttcagcgactgacccaccggctccaacatgatgtagcgacagctatagcggcgttcgaattggaccgtggtcggcaataattcaacatggcgcgtgtcgtcttgaatccaggctgtgggcaaccaactggtcacgcgactagcatcgacacttaactcttgcaactgctcggcaaaccttgtccgcatcagtaacggcgcgtccattggcgaaccggccacgtcaatggcaacttgaaaatggccgacgtatagcgctcccaaatcataaatcaaacgttcatgcttatgtagcgcaattgcaccggtgactggttgccacgtagctgtcgctaaggtagcctgattgatcttggtgaccaccaaataacgtcgtggctgaatggtacgggtagttagtggtactgatatatttgcctttgtcagtaatttaggattggcagtaaaacattggtcagtaagcttatgaaacttgtgatcatcttcattactaaaagtaactgtcattttttaaccccatctctatccgtctaagttgctaccgaataccatcttccaaaatctaatcatgaaccagtaccacgacctttcactcgtcagcctcacgttcgtattaagccgcttctggctcccagcgttcaaaagcgccaatcagattctcagtcatctgtaactcgcccatcacgttgactagtgccgactgggcattcataaagagtgtcgagtgcacaaaccgttgagccttggcattctcgatcagtcggcgtacctgtaaccgctgggccgtcagcaattcagtttcggcctgacgtaatttttcacgcgccgcctcgtagcgataggccgcaatctcggctaaggcagccgcaatcattgaccgggcgctgccgattttcaaaatcatcgtcatcgtaaggttgagcgtgtgttccatatttttctgcatgtctacaccttttttctttagatttcctactctttgaccaatcgtacacacttgtgttgacggtaatcttcatcgtcgcgccattcccccaaatgacagcaatcatgatcgacaatcagctttaaaatgtcgtgccgttcacatgaatgcgccggccgttagatgtcttgacaccgttaacttatgtcatagtatagcattattttcagaaaacaattccgactttttcaatatatacataaactttacaaaatgaaaaccggggcaatttacgtgcatttgtcccggcttttatattaatattatattttcacagtgattaatttatccctgcccgcactaccgatcatgacaccctcgattaatctaatgagtcagcggccggactggtctttgattcatctccatattgccagtcacgcatttgatttgccgcggctgctgaaggataggcgttattatcgaaccaggccccagcaccactagcattcattaagactggaatttggcggccatcaaaataatgataacgcacgtattcaaagttaccggccccagcagtctgctcggcccccataatatgaatccatttttgtccctcagctgccgcataagatagcttcaacccgtcggtatcattttgcgtcatcgaattaatcttgtgatcgtacttattatagtaataccaagtcccctgataactttgaggccattgattagccttcgcatcacgactcatgttcacgttcagcgcactatctgtcagcgtcgtcggtcgactgcccgtaatgatcttggcaaagccggcttgcaaagcactgttctgcgtgtcatgaatgatcaactcgtccccgttggtcgtctgagtcacaaagacgactggtcgccgatgatggaggcaaaagaagtacgtgtttggatattgtgcttccgccttaccacccgttgcgacggccaccacttgaaattcactacggtcttcgccgtccttggaccacttgagatccactgactgcgagccccacttgattcggcctgctaagctaccattaagcaaagcattgggaaaacgaaaacctaaatggtcaggaaccttgtcatcatacgtcccgacataggtctggcccatctcgcgttgccaagcggccataaacgttgataaagccgcttgcttgcccgtattccacaaggttgcctcagccggtgatgaagaatcactgctagcggtacttttttggctagcagcctgctttgccgctaccttggttgacgttgctttttgactcgtcttgggcgctgacgacttgggcgacgtcgtgcatcccgctaataataaacttcctaataataatccgacccacacttttttcatgttgctcctcaccggtcccgtaccggtatcccctattcaataattacttttatggtaccaaaaaaagtcggcattgtgctgggcgttacaatataaatcttcacccatctcacttaccgactatggctatttacttaatcgtgatatttaacgtccctaaatgtgtaatctgaccgcacagttgatcgccggcttgcaaaaagacttggggattgcgaccaacgccggtcccactaggcgtcccggtaaaaatcaaatcacctggttgtaactcacagaccgtcgacaggtagtgcaccaaatccggcactttgaagattagttggctcaacggcgcttgctgcatcgtctgaccattgacggtggtcgtgatcacctcatcgtctaagttagctaattcatcgacggtcgttaaccacggcccaactggtgcgtaattttcaaacgatttacccattgaaaactggggattatcattctcgaactgaacggctcgatcagataagtcttcaccaaccatcactccggccacgtgcgccattgcatcagccgtcgcaatatcgcgcccacccttgccaatcatcacgactagctcggtttcccagtcggtctcagggccatgcgtcaccacggtcacattcgctggtgccagtgaactactaaacttcgtaaaaatacttggaaccttcggcagcgtaatgtggatctccgccgaatggtcgcggtagttcatccccaccgcaaaaatctgttgcggggccgtgattggtgccgctaattcttgcggcgcaaacgtttcaagcgagccaagtttccggtccgctgctagcatatgtagcgcttccaaaactgtcttcgcatttaaaactatttgtccatgctgttcatccgtaatgataaacggtcggttggcccgcatgccaattttcatattaatcacctcattgatattattgtacactcatctcatgaatcataacaataatgatagttgcgtgacggtcattccggacaatctttatgaacgttcaaacgcaattacgaacttagctcaggatatttcttcatgtaacgctcatcactaaaaaaggtacccgcctaatttgcgagtacctttaaccattacggctgccattaatgtgggccgtcatcctttggttctgggtgtttcttttctggtgctttttcttgcttgtcattttgttgccgccactcttctgtcgttaacatgtctttaacgactaattttaacttagtcacttgataaccagtcattgatttaacggccttggcaaccttatccgccacccgtgctagaatctcctgaccattcttaccataagctagaatggccgtcaattcgattccaaccgtctggtcatcgtcatcggtatccactgaaacaccggtctgcgggcgatccttatccgtaaagcgattggaaatatcatcaatcagatttccctgtaagctcaatactccttcaacttcttgggccgtgttactagcaatctttgccaataccgtatcgtcaaaaacaacttctggttttaaagatgtcgctgttgcttccatcaaaattcctccttgttttgtcaaaaatcgtcttaccaatgactactctaaacgaccgtgctattcaacttgccgcttatctgttgattgatccgtatttggtttgccagtggcctgatcttgccaatcacgcttgctcatgacgtcactgacatgtaccttaatttcaatgaccttcaagccagtataccgttcaacatcttgctgaacacgttgacaaatttgattgaagatttgtcgcatgtccttaccatattcaacgatcatcgtcatatctaaagcaacttgtttcttaccaacttgggcgtcaaccccctgtgtcgggtcagcttcatcacgaaagcggttcgttaaattgcttaacatgccgccttctagggataacacgccgtcaacattgcgtgaagctagaccggcgattttttcaatcacaccgtcatcaaacgtcaattgagtctgtaattgttgttctggttgtgccattgtaattcctcccattatttagataaatactcactcaacttctgactaactgcagccaaatcgacgtggacaaaccgtccaatcgcccagccgatcagccctaaaactgcgactaataagactgccgaaaaactggttaatacccagacgatacctaaaagcagtccaatcagaaaaccatactgtgcgttactcatcaggaccctcctttacaccacggttaacttacgctggtgatttgctggcttaacttgcactactggttgttcgaccgtcaatcccaattgattcttcaaatagtcctgtgccaaggttgccgcctgttgggccgtggtttctaacgatgcgtcagtattaaccatcgcatcaatttttactcgtacccggcgacgacgccgtaatttcaagtgaacctcaggatcaatcagattcaactgattaacgagtcggtactgcaaatcacgttccaaagcccgttgcggaatcgttaactggccaaccttgccatcatacgtcaacgtgctgactttaactggtcgaaacaagccgacaattaccaataagataccaacgattccggcaataatggcaaagaccatcaataagatactccaaaccattgggtagttaatcgtcagatcagctaaccaggacgtcaaccacgggatcgggtacaactgacccagttcaaaaaccgctaataacaccaatacaattccgactaacgtcaccgtaaacttagctaagcggctcatctaatcaccgcctaacgttttttacgcatgccgaagattgcagaaacgattaatactaagataatagcgcctaagattgagggtaccaatgccataccagctaacgaaggtccccaagttccaagcaatgcttgaccaatccaggcaccaactaaaccggcaataatattgccaatgatccccattggaacgtcacggctggtaatcgcacctgctaacgcaccaatgacaccaccaacaattaatgaccatagccatcctaacattctaatcactccttacagttatatttgagtacatgcttatgataaccataatttaattttgggacaattaatatgcacactggtcgaattgtcacttaaaatctgaacaattaccatcaacgaatcccgccgcttcgcaatttaaccacaaacataaaaaaatcagcctgccaattgttacatcgcaagctgattatttctattaaattgactactaataactgctctgacttagctagattaggctggtttagccggagtctgtttggctgccgtcaatgcttgattgattaccttggcgtataaaatatcaccagcccgaatgccaccgaaatgtacgccatccgtccctttgaaaacttctggatgttgcgccgcaatcttgccccagtcggcaaccgtaatgaacttatacttagctggcagacgccgttccaaaacggccaactttgatgaattccagtcagcatcggcccgggcattataaggtgtcatcagaatcaacttgtgccccggctccaagtcatgaatgatcttcatggtttgttcttcgtaatcatccagcgcgttggtcccaatacaaatcaccacgtactgccgtaacgtatggcttcgctgctggttcatcatgactttatatgccaggttcatcgtccgatcgccctccgcatcaatattgctgttcgcgacgtgatcgcccaggtagctccgcgtccccagcgtgacactgtcaccaataatggaaacgcctggtgccttttcttggtcacctttaggcgttgcctgcttcttcttgggcgtcacggccgcgagcacagcttcatgagtcgttccgattttatcaatatcttggtaaatcccgctcacccataaattctgttccagtgtcgaaagttgcggcgcatttttgactacgaccccggtattaactgccaacaacactcctgcggtgataacaggtaactgcaactgtcgccacgtcactgtatgaccgaaaacgtgggcgcgtttgcccgcaatcactggttctaacacgtagtatgacaacgcggataggataatcgacagtaccgtcgtgagcagcgccgccaaccagttgaccatcatgtgtgaaaaaatcacgtacaacggccagtgatagagatacacgctatagctcacatccgctaagaacgtcatccaccgcggttccttgaggttcggcgtgtgatcatgcaacaaccgggcgccatagatcatgatgccagcgagtacagtagccagtaacagcccaccctgatacgtttgtagcgcatcgaacttcatccggtcgcctaaagcaactaacaagataaaactaataagcatcaccgcgcccgcaatgatcggattgcagtgcgccgtggtccaacgatagattggcccttgagctttgatgccgctcaggacaccgataagcccgccgacaaagaacggaaaacagtgggtcagacttgaaaagtagactggtgaaaagtcctttaagccgaccgcgccaaagtacatcatgacaaagctttcaatcgcaaaggcagtggtcaacagccctaagccccaacgaaaacgggtcaatgcgcgccgaccactcgccaaccgccgactgattttagcgaccaaccacgcaatcaggccccataaaatataaaagtgcatttcaaccgctaatgaccacgtatggacaaataagtgcggaataaacttgttttcataactgccacccgtcgcaatttcaaaataattagtcgtaaatccgagagccgccgcgacctgcttaccaatgtcggtcacaaaatcgtgatcaatcaagtaagttagcggtagcaccaataacaccgcaataaataatggtggcacaattcgataaaaccggcgaccatagaaagccattagtttaaagttatccgaacgagcaaactcgtccaccattaatgacgtaatcaaaaaccctgagaaggtaaagaagatgtccaccccaataaagccaccagtaaactgggtttggaaaaagtgatacgtcaataccagcacgagtcccgttatccgtactaaactaaaccatttaatccgcattttctaacttaccgtcccccgtaatttttttggcataagtcttgttgccgacccgcagtttgaccacaccattcaacgcacccttgctgaagttgccttgcaagcgccacccgttcggtgcgatgaattcgcctgggccttcaaaccggccattggtaaaattacccacgtagcgcccctgtttgttaacctgcaacgtaccctgaccgtcaaacttgtgcttcaaaacggctccgctgtagctcatccgtccgtgatccaattgcacactttgctgcttcgccgttgatggtgttagactgataacggcaaaagtgacaataccgataatcgtgataatttcaaagaccattctgctactgatttttcccatacctctattcctttcacaaccttaatttcccttaaagcaatcggcagttagccaccctggatttcccaatcatccacgggattatacggacacattatgtaccatggctgtcaattgcaactctgcatttaataacggatcatttttcattccgttaattatccattaatttaattcgtttatttaaataatcaaaaaaacttcaatggccgtattacttaatatattactaaatattagccttgccgtgtacaaaatatcaaaaatgagttgtcttttattgttaataccggttatgtttaattcactaaacttaatatctaaccactaaaaaaacagtcaggccaaggatttcggctgattgacaaccataggtaagcattcattgcctatctatcattcccggtatccatcggctatcctagtccaactgtttttattatttcatatgatcaataattctaaaaatctttgagctcagaagttaatcgcgtttacgtaactttgttaatcccaacaatgagaaccctgccgctagtaatcccactgccatcaaactcgatgactgtttttcatccgtttgtggtaaagccgtggcatgtgcggcaactggctgttgtttagctcccgcaatcagcttagttgttgcatcgccatctgaaacatctacgctagtactcgtggcattaatggtaccattgctattcgctacggttttagtagctgtcgcatgtggtgcggtaacaccagtcgattgagcaacatttgttgtttcagcaattctatcagccgcagcagccgtcgtcgttgtaaatttgttagcttcgacgcgtgccaagaaggctttagtagccgttaaatcaccttgtgcaacggcgagatcaactctggcagcgccgagcacctgcttaagttgtgctaaatcggtctttttacgatccagttgcgcttttccagcagcaagttgctcgtttgctgtatcgacttgagcctgcccctgcgcgagcatggccttggcaacagtgatttgttgttcagccgtagcaatttgggccttcatgcttgcaatccgcgcgggcagggccgcgatttcggccgccaatcgggcgttttcagcggtcaaatcggctaccaatgtcttggcactggctaagtttttagcggcttgcgtggcagttacttgcgccgcagccgtcttcgcgattgctgtcttcaaattacgaacgggcgatagttgttgctgttgcgccattgctaattgcccttgagcttgcgtcaaagcaacattagccgctttcaaactagttgcagcgacttgaacttgggcctgtttagtcgtaacagtcgcttgtaagccacttgtctggttttgtaaagcttgtaaactggcattttggttagccagcgtggttgctaatgtcttcccggtattttgtaaaccatttaaactagccgttgcagcaatcaacgttgcgttagccgccgcaatcttcttcggatcagcgggggccgtctggacgtaattgaacgtgacagctggtaaggccttagtcccagtagcggcattcgcatgggcattgtcgaacaaatcaacatacttgtcttgctgtgcttccgtcatcccggcattatcgacttcaaatgccgccacgtgtttggccaagttgatggctactccggcatcaccagtcgagtatattaggttgacgcggtgaccaaaggaaccggactcaatgttattggattcatcataccaacccatcacagcattataggccgtttcttgatcgctcatgaaccattgcggataaacttgtgttaaattttctgcataacttgagccagtatgatccaagccaccgtcgacttgggcagctgctcgcgcaatcgcattattttgcaacgtcgccgtctgtttcaatgctggttgaccattcagcgcccgtagctgattgatatattcaaacatatactgattgattttatccgcattaggcacatacttgccattacttggataggcgacgctgactgtttcggccccagtcaattgagattgtgggaattcggcagcgtcatacttattttgcgattctgtcgtggtcgttggccgttctgctgctgctaaagctgcttgagctgcggtcactttggcttgcgctgtggaaacagcttgattattcgcattaatttgactggtcgtattttgaatcgctgtcttggcagaattgattgcctgggtatttttattaaccgcatcttgcgctgatgctacggccactttagcttgatttacttgggtggccgctttttgctgggcggcagatgcttggtcaaccgtcgcctgtttagcggcagtgacggcactggctgcatcggcatcagattgggccgtggcctgttcagttttagcttgcgtcaaggccgtgacagccgcgtccttagccgtttgtgctttcttctcggtagctggctggttggcgatagcgactttgttggccgcaatttgctgttggtcagctggaatttgtgtttcagctgctgccgtttgcgacttagcagcgtcgactttattctcagcctcagcgaggacctgattgttagcatccagtgtttgttgtgcacggtcaacttgggctttaccagcatcatactgggactgtccaatcgcaactaattgactttgattagtcacttgcccctgcgcagtcgccactttagtttgtgttgtattgacttggttttgagccgtggctacgttccccttggcagtctgcacgttggcttgatactgttgctgactagtcggtttgaccgttgctaacttttcgttagttgccgtctgagcgctcccctgcgtggcactcgtctgattcgtcgtatcgctgttatcagttgccgtgtcggcctgcgcattgttaacacccaattgggtccccacgaataatgccgcagtggtaatactggtatacaataatttcttattcataaactcactccaataagctaatataaatatcattataaaccaatgatgccataatgctagatggtgtttacacccttatgtcctgattgaacattggaaagccttatttaatcaggactattatgaattttagtcgttgaagaagtcgcaaatcaggaagtaccattgttccaattttacagtataaagttattttgataatcaacaattgctaatcaaacattacctagttatcattaatagccactgttttcaaaaacaaacgaaactagggtggtatatttctatccgattaacgacagtcgctggtatacttttattcacttgtttctctattgtaaggcccttaaactcctagttgtacctaattcaaaaggagtgagtcctattttcaatcaaatcactatccataaccaacatactgaaaattggcttattattggccttttctgtggggcttttgtgactggtgctgacgcatttattatttcagcactactccccgctatcgctactagtctgcatgtgccgactaacaccgcggcatacggagtcaccgtttacgcactatgttatgccatcggtgcacctttattcggcccattaggtgaccgctttaataaacgttttttgctaatcagtggctgtggcatcttcttactaggaacactactctgtggattagcaaactcattgctaacattctatctttaccgtgccatcgctggcatcggtgcagctttatttgtcccaaacatttgggctcttatcggtacttacttcaatggtcaacgacttaaccaagtcatgggcatcgttatgtcggcactttcattatcaattgctaccggtgtaccactcggtgctttactagcacaactcagtagttggcatatggctttctggggttcagccatgctaaccttgattgcattatcgattttaaccattgccataccttcattaccgagtcagaatgcccagcctgacggttattttacaagttttaaaacattagtccacactcctcacgccatcgctgccctactgattacattaacttggatgactgggttctatggcgtttatacctttttaggtgtttttgcaaccgcgacctttcatttcaacacaatgcaaactggtctcatctttatcacttatggaagtgctaattttgttgcgagtttctttgccggtaaacttatatcattgcttggtaaaaaacagagcgttacaattaatggcttagtttcagctacattagtcttatccttaggcatctggggacaacatttagcagtattgctgattattctggttgtgctcgccttatctcaaggctggggtgtcactgcattaactgcgacaatcgttaatattgtgccatctaatcgttcaaccatcatgtcatttaatagtgcttttttatactatggcttaacgttaggatctgccgctggcggcctgcttttaactaaaattggcttttacgcagtgacgattgcagcggccacggccttattagtcgcagtattgattgcaaatgcacttagccactattcggattagctttgagccaatcagcttttaatgcgtattaaaaaaactgctccgaagattcctgcgagcaatttttatgattgttaaaaatagtggctaataatgacgtcctatacttagtctaagcgttgaccaatcgactacgccaactgtaacgtttcaaggtaagccttcccccatcgatccattgcttcaacgattggaactagtgatactccaatgttcgttaactcataaactgaatgattagcgaccgtttgttgactcacaatctgatccgcaactaattcctttagttgcatcgccaacattcgactggtacagcccggcatgccttttaataaggacgaaaagcgctgcgaactccccattaatcgacagataataattgatttccatttacccgacaagatactcaaagttgtatccaatggacaaaattcttcatgtcgccgactgttctcaattggtgtaattgtacgcatctcgccacctccatcgaaaattgtatcataataatattcttggtataactgaactgtttaatattattaagtgaccaaacaatgattaccactacatcaaccacaccgctattaataaaacaagcagcgcccaaaatttggacgttgcctgttttaattattacacatcacgcgactaatacgcgcatgtcaatcgctacgtcaataggataacctgttttaacgtgaaagcaaagtcaacatgccaaccatggccaatgaattattgataatgtgcaaggcgatactatagcgaatatcgttgaaccacacgtacgtaaaagtcagcacgacggcgatcggtaagtaggctagtagcgcagggctaaacgataacgtatgggcaagggcaaatactaaactcgcaaaaactaatgcaaccgtgaaactcacccaatttgtgacccgcggaaataaccaacgatacatcagcccgcggaaaatcagttcttcgacaatcggtgccaatactgccatcatgacaacattaatgactggactagtagtaaataccttatccaaaatcacttggttttcaggggtttgtttcacgataagtcccgccaacacgttacctaactcaaccaggataaataggcccactatcgttaacaccggacgtgtcggtcgtgataaactggtcacgattggcgcttgacgacgataaatcgttaccagccaccaaatgagtgatccgagcaagactaaacttgccactccggcaattagtgttgccgtggccgagaacccatgtcgaattgctggcatcatcgttggaatcatagctagttgatatagtgcgaatagaccaattagtttaacgatattgaggagccaggtgacaatagaacgattcgacttcaaaattttccaacctccttatgtgtttgcatcagcttttcagctcgttttgggattagtccgccaagctgactaaacatccactagtgtccttgtcataataccataatgaagaccatttgattgtgaacaatcacctcttcagagtgaaattatgattgcactatttgaccagtctatcttaagaaactacaatcatcggaaaacagtgatcgttttaagtctaaccacctatttttaattatttatctgtttggagaactctgccgatattccaaatcatactaattctcaaatcattatctccgtatatattaaagtgagaaaaatcgtatctaaatctagtagcatcctaggaataaaaccatcatctagataacacttgatactaatctattttgttccaacaacctgaatgcattataattaacaagagattaatttatatcgataaatcatgttttatattaaatagtttatttaaataagttatttattaaattttttatttaaaaatataaattttacgtttaaatattatacaatacgttcattgggagactataacatgccagcaaaaacacaaaacaacttcattcgaagactaattaaccttcgtgacagtcggaactggtcaaaaactgaggtggccaggaaattagggttgagcagtatgcagcgatatgccaactatgaatatggcacgaatgagccagatttgaacatgcttaaacagattgcagatctatatgatgtgacaaccgactacctgctgggtgaagatagcgcatctaaatggattgctagaaaagataccactgacttaaaagactttctcacagctcatgtggattcgatgacatacggaggcgaagcacttacggaagaagaacgccaacaagtacgagtagcaatggccgtcatcttctgggaatagggctaaacgcgactaacgccccttacgatgaagtatcttaatgttcgaaccaagttacttcgggcacgcttatggaaagcttatttatcggccagaatattggtcacctttgtttatttatacgaaaaataagcctatcaatacggggattaatggtttgggtaggcttcaacaacttatgtccaataaactgatcgacacgaaaagctgttaataaagggaggagcttcaacatgaagtcaaaaaatttagcacttactaacgggattgtagggctagtcggcggcattattttattattcgggggctggtttattgctggtggtattgttagcgatgctgccactggatcagtatctaatacatcaggtgcggccgctttcctaaacattttgaaaattgctattttagcattaggaattattgcattaatttattataaaggtgataagcgtgtcggtactgcatcaggcgttttactaattgtcggcggcgcaatcgcgcttattccattcttgggttggattggcggaattctcgcaattattggtggatctttatatttagcttcattaaagcattttagtcaaccacaagcatagtctaatctgcaatcagttagtaatatcagcccttaactgggcttttattcaggcccaaaaagaacgtacgttccaattgtgcaaaccatttataaaaggccgttacaattaacgaattctgacaagtcttttgcaattgcaaagcaaaccaaatttactcagtgctatgcacacatttctcaatactgacattcgaatgcccgttggctaacaaagttaccaacaatttgttaacacttcaaagttcatagcgactactatcaccgggtttatcgctactgctcttagaaacgcccgtggaacgttaactgatgaatatagaataactatccttaccggatggattcgatatgctatttaattctgatttgacatacttgcgataaatgccgataagtacacttgtcagccagcgtttaagctgaatcaatccttcaactatcataaattctgacaatgcttgaaaaaattttaaatgaaatttttattgatatgatgtatgtataaaagcaagaaaaatgtatgcttactaaaacttgagagaagatgaaaacattttgaaaactcacttttttacagttcactctgtcgacagtaatacttacgatttaagtaatatcaaaatatattttagcttcaatggtataacagttgaatcaattagtcgtgataaaagcactgtaattgcagttcgtggtgaattgaatatagacccaatttattcacaagtagaaacttcaagactaatgagaccatggttacttgtcattcaagggataatttctctatttcttgaatgtcccatcactatttatgacattactgaatcaggatcctctttcgtggttaaaaatggtatcgacaatcccccaaaaactatttttcaaaccgaaatgaatgactattcaaaagatttagaaaaagtattatttaaaatcaatgattcaaagtataaaaacctttctatttctctactcgaccgatggcgcaaaaatctcaacctagagaatgaggatttagaaagcaatttatatcgtgatgaagctttacttggactctttcaaattttagaactattgagtaacagccgcgaagatgaattaaagaaaattgcggaaagcaaaataaagtcaagtttgaaagaatatgcttcacttatgctaacaaggaatgacgaacttgataactatgttaacgataattataagattgtatcaacagctctaggcgcaaagagccctaactttagcacaaaaataaaatatttactatcaaaaaatggtatagattcagaaaatgatatgtatttcgttgaatcagtaattaaacttagaaatgcgattgcacacggcagatttttatttcagccaatattccggtggccgctgactccattttttaacatttctcaaaacgtatctgaatttgacgtgctacgttctctagtaaaaagattgattggaaacttttttgaaataagtacttggaactctgactatacagaagtttctaaagcactcttgaaacctcccattaagacaatacagaagtttatgaaggaacctgagaccttcaaacaggttacgtttgatactttagaatcctcaataggaaacgaaactggaatcacctgggcaaatatttacctcagctatattgaaaatcccaaaaaactcaatctagatgatcttgctaattcattaaagcgttatttctttaatttgaaaaaaactgaagataatattgacgatatttttgtcacttcagtgatttttatggaatgtagtaatgatgaagtagttgctgaatgttacagaaagatagaatggctattgaataacacgcattttcacgacagttccctaatcaatattatgcctgagctagattttcatcacattcaatatcctagatataaaaaattcattgaaatgagacggaacattgatggtgagttttaaaatcaagttagccactagtatttttacaaaataaaaacaccaagacgaaaacctctttcattggagttcctactgtacgagtatctgtcaagttgtcatttgaaataatataagttttgctctacttaaacggcctcattccagtattccgctggggtggggtcgtttcttgctgatgaacggtctagctgattaaagtagttgctgccttcttcaaccaaggccactaattctttataggtagctggtttggcatgtcggtccatccaacgtaatttgaaatcgttccattggtgcgttatcatatggcgttcctggtcgtgacatgctacgagtacctcatgttgcgccaaaaattattgaatactcctgatatgtatgccgaacctcggtcagtatgcactacagggtggacgtcacccgcaaaattaaaggcccgttgaaaaacctgaacttccgcattcgtagtttcagtttcacttagtttatgggcaattagatgccgaccgcaaagacccagtagccactcaagcgtactttatactgaccattaacaccataaattaattcagttgaatcggccaaccagacctgatttggttggttaacgctaaaatgctgatttaaaacattatcttgtaagtattgctcctgttgtttgatccgtgaatgctttttctgacgaacctggcaacgaattccaagcttgatcataattcgcttaacttgctttaacgtcacctgttcggtaacggtcgggtcttttctgagattagatagctgccaatactttgatgatgttggttataccagtattgaacccgttcagttaagaagttatctcgaatttcccaagtcgttacgtcacgatggagccccttataatatgcctggcggctaactttgagtattgataataacttagtgaccgtaccgtgattattttgactaacttccttgattgcgtggtaagccagtcgacgttgtgaattcacccttgcgctaaagttcctgatatttttttatgaaagcctctaataactgctgatccttgctttgtgattctaattgtctaatccacagattggctttgtccaaatcggttaattctgattcgggtttacgatgtcctcggttatcgaccaaaacttcaaaacctttagcttggtcctttaaggcccaataacgggcttgctgataagaaacgttgaaatgttcggcggcctcactgtatgaatgattacctttattaatccattccaaaatcgttactcgctcattaaaagtcgttttacggctcattttaggacctgctttctagacggtgaagccgtcacagtttgtccctattatacttgattggccagtttcttagctgtgaagttgaacgtaatccatatttattagttaatccttgaattgttccctcgccattcaaatatgctcgaatgatcttctgcttgaaagtctgactgtagtgctgattcttagtggcctctgctagtccatcaataccgtcacgttgatagcataacatcccattatctaatggaataacaactcaattcatgttgcttgctaaatgcgctaatagaaaggccagagctctgaaaatcagtaattaaagccaatttttcggccggtgtatgtctagaccttggcatataaaaaatccctccatggttgtcagatgaattatattatttcatctgacaaccataaagggatcatagcactgcaacaggttctagatccacttacttattattaataatattctattcaaaatcttttgcgtcaccaatgattatattttttcgtcggcaacgacgtaatgttattggtccagcaatcggtgccaaaagacctgcaatcaaaatgccaccaatcagtgtgacaataatttttccaataacagcccagaagccaccaaagtaccacatgccatttaaaatgcgtcctatcaaactttcacgataccagtacaaactaaatggatagaaataagcacttattgccgtcagaacaatatgcaatacactcatcgttactcctaataagctaacagtaactccaattcctgattgcatacctggataaaagatggccagtagaatcataccataaatggtccacacaactggtattactagtaataagtgagctaactttcgcttccaataatcgggatgtaaataattatatgcgtctaatttatggctaagttttttcctagataccgtaggctttatctttactggcttgggcggccgaacatactgtttcttttctgtcattcttcactactcctctgttgtcactataacattgcagcatcaatatcctgctgcttaattgcagaaaggtcttctccttgctggccggcgacacgaacagcaaatttcctgattaacctttcattaagattacgaacccagcggccattactatgatcgtgagaaacattaaaattatgcataactaagtccgtgtatgcagttttatccacaatataatttttagcctttaagtcattccagccaatttcaattaattcctggggtgtataatcttcaaacataaagtgattaggaatccggcttcgcagtccctcattcatttttaagaacttttccatacgatcggtatacccagcgaaaataacaacaacatccgcacgatgatcctctatgaattttaaaatctcatcgatggcttcccgtccaaagtctttctcatccccgttagctagcgtatatgcctcatcaataaataggactccgccaagagcagactctagaactttacgagtttttatcgcagtttcgccaatataacgtcctacaatgtccgaacgtgaaacctcgacaaatttctgatcgttaatgattcctttgtcaaataaaatttcacctaaaatacgtgcaacggttgtttttcctgtccccggattacctaggaatagtgaatgtagtgtcatggcatcactacttatcccttgctccttacgctgcttattcatttgggctatagcaataaattcattaatctccgatttaactccactaatccctatcatttcattgagacgatccaacgcaggctttttaccaaaataactcacttgaccctgcttgtccgcggaaatgtaatgatttgtttgatccaccacaaacgtcccattgtttaaattatattggtagtaatctaatgctgtcttaccgatatctacattccgttcaagtttcaaatttggatttgagatttgtccaaaaataatatggcagacctgaatattagagcggcccgcaatatacaaatttactttgccgttgtcacgccctagaataaaaaagcgatttccagtgacttgtgttccattttcgattgcaaagctttcccgaatcagtgtttcgttaatattagccgtggtgtgatctaaactaactgaatccacttgaccacctttaagtgtcatttgactgtttaacaccaatagagccatgtcaaacttgggctgattaatagaacaatcttgacaggttaatttggaatcacatatatgaacgcatggatacacttctttagacagaatttttccacccgttaaagttgacgatattaattggatagtactttgttcatttccgttaagcacacaaccgtccgtgtattctagttgacttttatgacataaaaattgagcatgcttcaaatacacctttgcacaaatccatgaattacgaatagtcagctcagaattctcgacgtaaatacgatgctttccatctgaaattttgctagctccgactgttacattctttaattgtacatgtgaatttccactaatatacacaattggatagtttgttccagtcgttgatttgttaattaagtaaacatcttcagcaattacagttgaacccatacgcacagtaattgcattactcttatcagtatttttctgaatacaaatattttgcaacgttactgtagctccatccttcactacaataccatcgattgtattggtatagatatgttcattctctctattttcaacgtgaccctgaattgtaatacttttggtaataactatagattggttattttgaccgttgaacggatcaaatcccgcctcaatctcaatgacatctccatcactggacgcttcaattgcctgatcaaaatcccacgttgaccgccgaccaaacagatttttcttatcaggacccactagataattactcatgacccctcctcactccttttcactcactattctatactaactacactatcacctttgtatcgtgcactgcaatatcactagtcacaaatgtcaaaaaatgtcctactaatgataaaaaataaaattatcactcagaatttaaccttgattgcactaacttctgaaaacaaaccattcataatcctattacaccatcgatattacgcctgcattaaatctgaattagtacgcttaaataaaagtttgttttttaataagcttcattcaattctttgtaaaaatcattaccactttcataacttagaaattattttctgggttctctttgattcactcttcaaaagtgctaacaaactctttgtgatttggttcatcaattatcaattagatttagtcttaaacttctgtaattgccataacagttcttccacactctatatgatacatctctacttacttacattatccgcaatgttttgtgaacaaacaagaatccaataaaaaaagaatcgtgcaaatccttaatcactcctaagtgactaaagacctccacgattcttagtgagactgttgataggaaatctttcagattcgccaccaattcatccattttataagctcacaaatactgttaaatcaatattacgatttcatttttatatgattttctattcccattcaattgtcgaaggtggcttactcgtaacatcgtacacgatgcggttaacgtgatcgacttcattgacgatccgcactgagatcttttgtaagacatcccatggaatacgtgcaaagtcggcggtcataccgtcgattgatgtcacggcccgaataccaacggtgtaatcgtaggtccggccgtcacccatgacaccgactgacttgatgcctggtaatacggtgaagtattgccagatttcacggtccaagccggcttttttgatttcatcacgtaagataaagtcactatcgcgcacgatttctaacttatcttccgtaatctcaccaataacccgaattccgagaccagggccggggaatggttgacgccaaacaaggtcagacggcatccctagcttttcaccgagttcccgtgcttcgtccttaaataacgtccgtagcggttcaatcaacttgaactgcatgtcttctggcaaaccaccaacattatgatgtgacttgattgtttgggccgttgaagtcccactttcaatcacatcggtgtagagggtcccctgtgcgaggaattccatcccgtttaacttcgtggcttcttcatcaaacacttggataaattcgttaccaataatcttacgtttccgttcaggatcactgacaccagccaacttgcttaagaagcggtccttagcatcaactttgatgatgttcaagccgaacttaccttctaggctcgccataacttgatcagcttcgcccttccgtaacaaaccatggtcaacgaaaatacttgttaattgcgtgccaatggccttgtgcaataacacaccgacgacactggaatcaaccccaccggaaagtcccagtaagacctttttgtcgccaacttcagcgcggatcttttcaatctgcatatcaatgaaatcatccattgaccagttagcttcagcttggcaaacgtcaaatgcaaagtgccgtagaatatcattaccgtagtccgtattccgaacttcagcatggaattgaatcccatataacttccggtcaacatcttgaattgccgcaatcgggcagttcttagaagtggccaccacgtcaaaaccatcaggtgcttgagtaaccaagtcaccatgactcatccacactgactgttcagctggcgtgtccttaaatagggtcgccgagtcactcgtcacgtcaatgttcgccttgccgtattcacggttatcagctgattcgaccttcccgcccgcaagcgtgtaggtcatcagttgcatgccgtaacaaatccccaagattggtaagcccaacttgaaaatctccgggtcaacccgaaaggcgccatcatcgtaaacactgttggggccaccagaaaagataatacctttcgggtgacgggccttgatttcttcagcggtgatcgtgttcggaagtagttccgaataaacgccgaaatcacgaatgcgccgggtaatcaattgattatactgactaccgaaatccaataccaaaatggaatcgaaagacgcggtatccgtttttgccaagttgttcactcctttggattaattaatgctcaataggtctatcatactgatttctaaacgttcggtcaaccagtatgagaaatttcttaggtgctaatatttgcggaaatacacggcatcaatcacatgatgcgcaactttgtgcaaaattaaatccgcacgattacgggttggcaagatataatcattcaagtttttcaagttaacctcttcccaaacacgctcggccatcgccatcgcgtccttcggatcaccgatcgcccaaggatagaaataattcgtcggatcctggaaagccgttttcatcagggccttgaagcgttctaagtaccaatcttcaattaaatcggcatccgcatccacatacactgagaagtccgtaaaatcactaatgtagatcgcctgattgcttggcaattgcaacacgttaatcccttcaataatcaaaatgtcaggatgcgtgatcacgtcaaagcggtttggcacaatatcataagtctgatgagagtataccggggccttcgctaacggctttccgctcttcacatcgttcaagaattggatcagccgcgtcatatcatagctttccggaaaccctttacgttccatcaattgcatctttttgagctcggcattcgggtataagaaaccatccgtcgtaatcaattgcgtccgccggtctggatataaatatttaaatagaatctctaataaccgtgctgtggtggtcttgccaactgccacacttccagacactccaataataaagggtgattggcggttctggcggtgtaaaaaaacggactccgtttcccgccatgacaagtagtgttcatacttggcctgcaacaaatgcgcaaacggcatataaatatcacggacatcgtcgagactaatccggtcattaaacgcctcaatttcgtgcaaattggctgcggtcaatggtacttgatgctgattgttacgataaaattgcttccactgttcacgtgagaagcgataatagttcatctgatcttccatgatttctgtctgccaccattactaaattaatgggttgattataacatgaaacccttatcaaacgctgattaaaattcaaattaaccggattcctaattgatagccaataaccattaatagctcgatactagttaacgctgacctagtaccgagctatgctactgtatcttattcgattttcagttgtgccgcgacctcacgagcctgaccaaataacgtcgtaataatttccttgactggccgaattgtcgtcatcatccccgccacttcgccagccatgggcgtaccatgttccatatcgccatcttcaacggctttcgcaaatgaaccgtccgctaacgcgtgtaattctgctaccggcgcgttagtttgctccaattgcaagtattgcgccaacatcgggttaactagcgcccgtaccggatcgcgctggctgcggccagtcacgattgtatccgtgtcactggcagccaatacccgttgcttataactagctggaaccgggcactcctcagctgtcaaaaagatcgtgccacactgcacaccctgggcgcccagcgcaaacatcgccgcaatcgagcggccatcaccgacaccaccagcaccaatcaccggaatatcaacagcgtccacgacttgaggtaataatgccatcgttgacgtttgaccgatatgtccgcctgattcttgaccttcagcaaccaccgcatccgcaccggccgccaccatcttatgggcatggtggaccgaagcaatcactggaatcactttaataccggccgcgtgtagcggcggaatatatgaagtcgggttacccgcaccagtcgtcacgaccttgaccccctcatcaatgatgacttgggccagttctggacagttcttcatctgtaacattaaattgacaccaaacggcttatccgtcagcttgcgggttgcttggatctctgctcgcaactgttcggcagataaccccgctgaacctaaaacaccgagtcccccggcttccgaaaccgccccgactaattcatgggtcgcaattcgcatcatggcaccagaaaaaatgggatattgaatacctaacatttcagtgattgacatcgtcgtttcctcctcaggtcactaacaaccgttctaactagttgttagtattttcacgatattgtgtgcctagtcagtattaaggccattgtctctcaccgactactgcacttgatgagttaattttaacgcttattccatcgctatgatagcgttttctcagctattccgacacactttcccaactgttccaccactgatcatcctgacacaccttaagatttccttcacaagtaaaactaaaaaaataccactccaggtgaatggagcggtactcactgtcttaaactgacttaaacttttgcttcatttaatgtatacaaggcgtggttcacccgcgctagtaacggtgacaagctacccaccgcgactaacgttaactcgtgcatggcccgtgaacagattgtatataatagttgccgttcatcttcacgttggtaattttcctgattagcgttccacacgatgaccgcgtcaaactccaacccttttgctaagaaagacgggactacaatgacaccgggagccaagcgttgattttcagtttgaatcaacgtaacctgctcaccacgagctttcagggccttcgtgagcgcctcgcattctgctaaggatttcccgataattgccgtcgtatcacgttcagaatcgttcatcgctagctgatcaacgacttgatcaacccccgcttcaaagttaggcgtcacaacaacatttggcaagtcgccctgacgatcaaaagccgtgacggcttcaccattgactaaaatttccttggtgaaatcagtaatctgttgcgttgaccggtacgatttagtcaattgcacgacccgcgtcttttcagggtcaaataacgtggccaattcattgatcagcgaatggctgttttccttggtaaaaatcgcctggttcaagtcaccgagcattgtgaagcgagcttgggggaagctaaacttcaagaaagctaactgaaaggcattgtaatcttgaatttcatccaagaagacaaaccggatgtcacgctgcccgtgctttccggtcattaggtcatgcaggtacatgtaagctgagaccgttgttaacgagatatgacgttccttaatctcggctagtttccgttcaaccgtagcatcccagtcagcagctgagataccgtgatcagccaacttgatgatcttcggtacttcgcgtaagaaatgcgcgtactgcatgttgatgctcaagaaacggttacgcacgatttgcgtccgggcttttcctaagcgttgcatcacaattttacgtgctaagaatttaaactctttatcgccattcttaaattcccgcggctgattgccatataattgattgatctcttcgcgtgataagtcttgaaccgcttcttcgacccacttggaacgcatctccgattcaaccttgcgattcaaaatcttgattaattcttccttagttgctgataaccggttcgctaagtggtagttttcgttgaaagagtagtaaatcgatttaatcttttcccgggaaataatcacttcatcgttcaacgtaatgttacggaaacgcatgtccgcttgttccaaatgtcggccatacgtggtaaccgcgttgaagaatgcgaggctaccttccaacttcgtaatctttgccatctgcggtgtattttcagtttcaaaccgctgctgtaaagtttcaacttgcatgtgtggtaaccggtacgatgcgtattggaaataggtcatctgaaccatgttttgttcacccagttcgggcaatacttggttaatataatcattaaagagttgatttggtgagaacaagatgacttgtccggccgtcaaattaccccggtaacgatacaacaagtatgcgacccgttgtaaaacggacgaggtcttcccggaaccggccgccccctgcacaaacaggaggtcagaactcgtatcccgaataatggtattttgttccttttgaatcgtcgtcacgatactcttcatcttcacatcggacttttcatccaacacttctagtagcatcgagtcaccaacggcttcatcagtatcgtagactgtcacgatctggccattctcaaccatcaactgccgcttcaacttcacattaacggtctgctcaccatccggagtctggtacgtcacgtgccctaacccaccgtcataataaatactggaaataggcgctcgccagtcgtagatcaaaaagtgatccggcgtgtcagaaaatgaactgagtccgatataaatcgtctcaggcttaggctcaccagtctcatgaaaatcgatccgcgcaaaataagcattcttttccaacttttttaacgtcgataattgcttagtcgcgtgcttccaactattctgccgctcatccatcatctgttgttgctgccgcacggataatccggtctccatcatgccttcgtaactatccgttttaatattgatgttattcagcaagtcacgtttaatatcggcctgatctttttccgagcgcgtaatggtttggctttgttgttcttcagccaccttaattttcgcaaccacatgatctaagtgttcctgttctgcagctttaattgacttagccattgaacgccctccattcctaaatatcgaacaataattttatcactatcggcggcccgactcaattaataacccatggcagccgccagtttttgattttttatgcaaatttgtttgaacattggtctatcaaagttacgattatgttaaactgaaagaaatgtaatcggttacatctgtttttcaacccgcagacgcttataataaatgcaacttaaattggaggtggcgccgttggtcaatttaataaccattttaacccatttagaacaaagtatcgtcccactattaaccacgcttggtagttggtcttacatcttattattcgccgttatctttcttgaaacgggcatggtcgttttcccatttcttcctggcgaatcattgatctttctcgccagcacgatggctgcaactcacagcgacgccctcagtattcagattctggtgccagtattctttgtggctgctgtaattggcgacactgtcaatttcgaaattggccgccacctgattcgcttaccgtggttgcaacgccacctcccccaatccaagcaacaacgcgcacaacaattttttgctaagtatggcgcgaaagctgtcatgtttggccgctttgttccactcgtgcggacctttgtcccgctgagtgccggggccgctaaaatgccgcaaccgaccttcgctatctggaacttagttgacgttggtatctgggtcagtgtcggctgttcacttggttacttctttggctcgatcagcttcgtacagaaccacctctcgctctgttttctaggaattatggccgccgcgctcattccagccacagtggttgcgctgattaagacctggcgacaacggacaacactcaatctcaaataagcgccacacacaacacggttgatctgcaatcgtgttctttttattgcttctcgctttgaaaggcacgtctttccttttcaaaaccactcaaaaagtgtatcctttcaatgacttattcgagtggagggattctatgcaaccaattcaattaactgcctatcaatctgactggcaaaagcaagcaatcgagtatcaaaccttgttacgccagcaattacaggcgaatctattaaaaagtagtcacgtgggtagtacggccatgccccaattattagcgcgtccaacaattgacttggcgttgcttgttaaagatcaggcggctgccgtagctacgttacacgcacgaccggtcgctggaacaacgcatacttacgcaacgcaattagctgctaacgacatccacgtgatcattacaactgatgaacagcattatcagcaattgctcactttccgggattatctcaatgcacaccggacagacggccgcaagtatactgccattcgcgaaaaaggtgtgcgcaatgggcaagccgatctcgcagcctacctacaaacgaaagcagcattcatggcaagcatcaatgacaaggcccaagactggttagccactaaggatcagcatgaacaccacgaccggaccgtccgtgcagaactcgtcaacatgtgcctcatcaccaatccagcgaccggcgatgtcctggttgaaaataagattgacgcgcagtggtcggggttaacttttcccggcggccatgttgatcgcggtgaatcacaagtaaccgcgatgaagcgtgaagtattagaagaaaccggcttgcacgtcgatcaattgaaattagtcggcaccgtaacgtgggtcgaaaatgcggacggcgacgtgtcacttggcaccttatacaccactagtcactatcacggtgatttgctagccggctcatacgagggggccattagttggcaaccattgagccaactgacgcctgacaaattagcccctggtgtcgaccaaatcctgaaagttttcaccgatgcacatgctagcgaagctttctggggctttgatgatgatcagctccgtgtgtactaaaacgaatcgaggtatttattcatggatcaagtttccttagtcattattttattagccgcattattaattccgcttatcatggctaaattcaaaatcaacagtttgccaacggccgtcatggaaatcattgtcggtatcgtaattggccccagcgtgtttaactttgtgaacacctctgaccttatctcacaactctcaacgattggcgtcatcgtcctgctgttcttaagtggacttgaaattgactttagcctatttaagaagcggcgcacggcattaacacctttagaacaaaaaaacgcggtcaacacaccgaaatattcgccagttcgactttcggtgtacgcctacagcacaattattgttctatcgctgttactcgccgctgcttttaaagtcagcggcctcttcagtgatttctggcttgccgcgattttatttggcacgatttcacttggtattgtaattgcagctttaaaagaacaggaattgcttagtaaggctttcggacaaacgattctgctcatctcggtctttggtgaacttgtaccgatgatgggactgacgctctatgcatccgtctacggcagtaactcacaaagtctctggttactattactcattttagccgttgccgcactattactcttacggttcaaaccattcttccgcttctatcaaaatattaacaaatcgacgacacaactagatattcggttagccttcttcttgattgtaacgatggtcacggtggccgaatccgtcggtgctgaaaacatcctgggcgcttttgtggccggaatcgtcttgaaactcttgaaccctagtgaaacgacccgcgaacgcttggatgctattggttacggcttcttcatcccgattttcttcattacgactggcgtcgatttgaacttacggaccttattaacaagtggcaaaaccttactattaattccactatttttcttagcatacatggttgccaagattggcggctactgggtcctaaagttacggttcaagcaagccaatgctttagccggtaccgcgctgactgcaacgacaatgacaatggtattagccgttcttcgagttgccaagtcaatgaagacaattactagtgaccagtccggcgctttcttactcgcagcgctactcacttgtgtcatctcacccctgatttttaacaagttttattcagctgaaaaagaagacctggtcaaaacagcggtccactttatcggcgctaacttaagcaccgtacccgttgcacaacagctacgaaaaggctggtacgacgtgtcaatgtacacgaatcatcctgagaattatcaaacctaccacgcgcaagtgccagtgaccttaatggaaaacttcacagcccaggacttacaggatcacggcgtctttgacacggatattttggtactcggccatattgatgccgaacgtaactacgagcttgctaaagccgccaaagcatacggtgtacggcggatcatcgttcggtttgaagaccgcaatgtgctcaacgaacatgaagatgaactccgagagctaggcgtcgaagtctacaatacaccagaggccaacattactttactgcgcgccttaattgaatcaccgtcaaccttgctattgctcaatgatactgaaaacagcatctacgaagtcagggtcctcaaccatctctatactgatgttcaaattaagaacttacagtttgctcaggatattaccattagtcaagtcatccgtaatcggaaactgatcgcgcccaatggaaatacgacgattatgtacggtgaccgcttaatctttaccgggaataagcaaacggccgctcagattcgacaagccttagcaactgctaattaatcgcagtgcattttatggtaaactaaacacattatggcttagttttgaacaccaagtagaggagtaaataatggcaactttttccgtttacatgattcgtcatggtcaaacttactttaacaagtaccgccgaatgcagggctggtgtgattcccccctcacagctgtcggcgaacaggacgctcgcaatgcaggtaaaatgctcaacggtattgatttcgatgccgtttacgccagtgacatgacgcgggcaatgcgcaccgcagaattaattcttcctgccagtggcaataccgatttgacggttcaaccaatggctgccttccgtgaagccttttatggctattttgaaggtgatgatacgtcgcagacctggttcatggttggtgcgccccatcaagcacctagtttgtccgcaattattgaacaatacggcatcgaaaaagccaaagatttctgtaaagaagctgacccgttccatcgcgccgaaaataacgccgaattctggcaacgggtcaatggcggtctcgatacgttacgtgctcaccatcacgacggggacaaagttttggtcgtcagccacggcaatacgatttacagtattgctgctcgttttgccgcactgacctcaccagcacggccccaaaatgggagcgtcacgaaattcacaattagcgacaacgatgtgacgttagactactttggccgcaaagaccatctcgactaaataaggagaaacacatggctcaattttcaatttactttgttcgacacggacagacttttttcaacttatataatcgcatgcaaggctggtctgactcgccgttaactgaatacggacaagccaccgcaaccaaggtcggtcaagcactagcgaacacggcttttgactactactacagcagtgattctaagcgggcaatcgacaccgctcagctcattcgacaagcggcgggtgccaccgcccagccctttaagacactgatgaactttcgtgaagttttctatggttatttcgaaggtgacgattcaagtcggacctggtcactagttggccgccaatacggggtcaccagcatgcacgaacttcttgaacacgtgcctatcgatcagactcgcgacctgatgcgtgaaatcgacccttggcatgaagctgaagacaactcgatgtactgggaacggatcaaccagggctttgactacttgaaagctcaccacgatcaccatcaaaaagtcctcgtggttacccacggcacgacaatccgcagtatggtcgcacattttgctcctgaaatcgacatcacgaacggccccaaaaacgggagcgtcactcgcatcgacatcaatggcgatcaaattcgcgtcgtcgattatgcgcaagacttagctgacgtgaaagtcaatcaacacttataattttgctcatcaaacaaaacgctcgcaaccactgactggtcgcgagcgtttttatattggctctgaaataactgttgttggtaattaactaaatacgtgattactggcgacagatatctttatttgtattttaatcatgggctattgaacaattcgaattgaaaaaggtgctcgccattgtttgactaagcacccgtagcactattcgcaacatcaattgacagagaaccaactcggctatcttatcaatgatgtccttaaactttgctggttaaagacgtgtttgaagaattcaggtatgctaccccaattcaaactattttttcaaaaaagcaagcacgttcttcttagacggtttcatgcttcctgctaagaacgcaattacgactgccacaacagcaaacaaaagttcccagactgaccaattaaaaactaccgttaaagctaacataatagcagctgcaattatcaagacgccatctctggggcctaaattcagatacggatacatcatcatcagacgtcacttctttcactatttgttgtactcaaccaagactatacacagaattactgacgaaattaagaaacccctccgagaggtagtgcgttgaccgggtgtaacaagaaaattttgtaaagtcttggcaacagtgcgtctatctcaggtcggaagaagtctaagaataacccaaatattcatttaacttctaaaattattataacaccgctttcatgcttgtggtcattcttttataaaaatattgaaaagctgttggggcttcactgatgaatcacaaacccactaacaccccccccaatcctaactcgtgactttgataccaataatgccaatgaccagcattgcaatgaagatccacgtgatgggtgcaattgtatctttgaagaaaaccaggccaacaattatcgcaccgaccgcaccgataccggtccaaattggatatgcaatactcaacggtaagtgtttggttgctaatgctaagaagccaaaactcaagaccatgccaactactgtggccgcagcatagccaaagtgactgaacccattacttaatttcatcatcgtagcccataccacttcaaataatccagcaataattaaataaatccacgtcattatcaattcctcctcaaaataaaaaggacaacgtccacccaacttccacaatgacctaaggaagttgggttaacgttgtccggtgacaattcatcttaatatttcagtccactatagcaaacctcatctgcatggtcaagcttactcaccgcaaagcatccactttgtcagtggggtcaacggtgtcggcaaagcatctaaagcaaagaaagccgcagtactcgtctcatcggtggcttgaatcaattcaccacccgttgtattggcgcgatataacgtggtgacactgtcaataatgtccccgttaggatactgatagtgcatcttgggcccactatagacatcgatcagcgttaactcacccaccgtcagcccagtctcttctttcaattcccgtcgcgccgtttgctggaccgtctctcccggttcagtcgatccagctggcaagccccaacagtggttatcggttcgataaatcaagacaattttgccaatcgaattttgggccattaaagccgcaccggccactactagcggttggtgaccaactcgccgccgcaaatcaagcacgtaacccatttttgattcctccctaatacccgaagtcgtaatattttgattagacatgttatacttaatgcaatcataacacgttaggagtgagtgtatgtctgaaaccaacgctcaaaaagtacaagaagtcatcattgccggcatgtctaaaacggtcgccaattacgactacgccatgtccgagctagaagcgctcgttgcagccaataatatgcacgcggccctgcgaattgaccaaggattggaaaaacccaacccggccaccttcttcggcaaaggtaaagttgtcgaaatcaaagaagtcgcagccgccaacgatttgcacattatggtcatcaacgcggatctgacccctagtcaggtgcgtaacttagaggaacaaacggacattcagatcatcgaccgtactggtctgatcttagaaatttttggtaaccgtgcgcggagcaaggaagccaaattgcaagttaagattgcccaattacaataccaacttccccgattacgaacgagtatctccaatcgccttgaccaacaggccggggccgctgctggtggtggcgggggctttaccaaccgtggtgctggtgaaacgcaactggaattaaatcgccggacgattcaagaccggatcagtcacgcgaagcacgaacttaaggaactcaataaagacgaagtagtgcgacgctcacaacgcgataaagccgggctccccaacgtcgcgttagtcggttataccaacgctggtaaatcaacgactatgaatggtttagtgaaactgttcggtaagggtgaagataagcaagtcttcgaaaaagacatgcttttcgcaacgttagatacaagtattcgtcagttaaccttccctgacaataagcagttactgctcagtgatacagtcgggtttgtcagcgacttgccgcataacttgatcaacgccttccgttcaacgctagccgaagctgccaatgctgacttactcattcaagtcatcgactacgccgatccccattacaaggaaatgatggcgaccactgaaaagacgctcaaagaaatcggtgtgcacgatgttcctatgatttacgccttcaataaggctgatttaaccgaagccgactacccgaaccagcaagatgatcaactcatctatacggcgcgtgatgaggcctcactacaagctttgaccagtatgatcaaagccaaagtctttaagaattacgtgacaacgacgttattaatcccattcaatgatggtgaagtagtggcctacttaaatgaccacgccaacattctcaaaacggattacttagctgatggcacccaattaacagtcgaactcaacactgtcgatgcccaacgttatgaaaaatacgtggtgacacctgcttaaacgactcattcaaaaagatggctctaggattaaccgcctagaaccatcttttttgatttaacaatcaacccactctgttaatcgccaaaccactagtgccaatagtgaacatcattcagtcaccattaacgcgtgcaattgcgccaatagttcggactgcgaccgtcctcgccattgacgttgaaaagcataactagtccccttcagcatggcaattaacatatcagcttgaaactcacatgccggtttcgaaagcgttggcttcaaatcacgaaccagttgcgttaataagtcacataattgttgataaagttcgctctgataaaattgacggcgaccaggttcaccggcctcgacattcattaataacgccatgttgtgctcacgaatcgctaaatattccccaataacatgatcaaaacgtgccgctgcacctaccgaggtcgtggtcaagtagacttgattggttttaataaaagttgcgactcggtccgttaccaatgccaaacatagtgtacttttatgggcatagtgacgatacaacgttccgggaccgataccagcggccgtcgcaatatctttcatactaacggtttcgattgaacgcgcggcaaagagttgtcgcgcagcagtcaaaattttctgttggttaatttgtgcatcctttcgcattcgacacaccctcctatttacttaagttcaccatacacttttacgcatcacttgacaaacggagtgtactccgtttaaggtataattatacaatttaagggggaattcactacgtttgtctttttatccggattactaatcggcatcttcgttagtctgattggtggcggaggtgctgccctatacctaggtgtcttaaccagtcaagtaggccttgcaaccgcggtagccgtaccaacctccctaatcgtcgccttaccagccttattctttggttttataacacagttgaaaatcaaaaatgtcaatttcaagattggcaatcaaatgatcattgcggccgttcccggtatcatcgtcgggacattcagcgcacaatttattccccaacaactgtataactggattgtcgggacaatttttttgattatgggtgcgatggtactaatcaagtatgtgcaccattctaaacaaactacagccggtcaccaaccttggcaagctgccttctttggccttttaagtggattgatggtcggcattggcggcttaagcggtggtgcgaccacggctgccgggttagcaattcttgggctaacggccgttgaagccgctggtactgccacctatgtgttaactgttatgtccacaatcagtttaatcggccatctctttactagtacttttgcttggcaatcaggattggtcctcatgattggcgcaattatcggcgcaatcattacaccactcgtgattcgccatttaaatttagataaggtcaaccgcgtattaacgccatttcttggtcttattattatttattttggcatcaaaatgtttatataaaggcagataaaaagtcacttcaggcagtcgtaaacttgaagtgactttttgatatcccctactgaaaaaattcataatcatgtgtataccaagaacaaccttctccagcatgttggtggctaagctaactgccgacgactgactaggtaaacaacgataatcaatggcagcgtcaccatcatcacgggataaaaccacgccattggtaattgactgctaatcagcccgccaatgatggggccaagtgacattccgagatcaacaccaatataaaacgtactattggctagcccatgatcagctttcggcacgagcatcaatgctttagcttggcaaattgaaaacatcaaaccgtatccggcagccagtcctgctgcacccagcagtagcatcgcccaattgttcatgtcagttaagccaatcaatcctaatagattgaaaattaagcataaccagatgaaccgtttaaatggcacccggtcgaaccaatcgcggagaataattcgcaatactaataaaatacccgcgtacaccgggaaaaatacccccgctgccacatgaaaatgccgtgcagcgacgtagctgacaatataggtttgggtggcaaaatatggtaatgaaaataaaagcaaaatcaaggccacggggattactcgtggttgtacgatgcgaatatggtgcttagtcgtagccgtttgaggcgtcacaattggttcaccatgatcaccgacgaattgaatcatgatgatgagcagtaaactacagcccgctgctaaccaaaaaacactctggtaactgtaatgttgatacaagaagacactgattgccggcccgcacgccattccaagcgcattcgctagcccataaatgcccattccagagccaattcgatcgggtggcaataaactagccatccaggttgccatgcaaactgaacacaaggtatatcccaacccattcaaaattcgcaataacatgattaacgtcacgttggttgtcaaactataacctaaactagctagtagcaacaaacagccccccacgaaggtcaaacggtacttagagacccggtcggttaaattcccagcaagtggccggagcactagcgatgtcaaattcgttaacccggcaatcgtaccggcaagcacactactagcgccaataccgtgcgcaaatcctgcaatcacgggattgattaacattggactcattaaaaagaagaaactagccattaacactaactttacatccggcgtatataaacgcgtcttcatcaattctcatcactttctaaattctgattaacttgccgtaacaaatctaaaaatacctgttgttgttcggcatccaaatgggcaaacatttgcgcactcgtctgccagccatgttgacggagctgctcgcgtttagcacgcccactcggggtcactaccacttgcttggcacgcgcatccgttggactgaccactaattggacatatccgcgcgtctgcaagcgttgcacgatcatcctggccgtctgatgggtgatttcctggtacgtcttaaacgcggttaccgtgcgacctggctgatccgtaaaaaaggtcagtgcatccgcttgctcagtcgttaaccccaccgtccgcaaatgttggttgcgacgccgcttgatttgacgagctaaaatcagaacttgccgcgccaccatttcatcatgattcatcttaatcacctgccctttcatttatacagccagctgtataaattgtcaaccagcgaccgctattttttctagcagcctgaagatcattttaaacaacgacaaaaagtggctaggcttggttagcctaaccactcataccgttgactataacacatttttccggcgttgcgcggcacgccataacgaaaaggccgtccaacagctcactaagacgatcaaccaactcagggctgttaaggacagtgacttaactaaggtcgctgccaccaccacgccaataataccgcctaaaataatgccgaataagccgcgataatcgacgcggtcatggcgaataaaattcactgccgaaatcggcatcaacaatgcgcacgacagcatcataattgggaaggcggcaatcggggtcaatcccagaaaatacaccattaccatacacggtgcgtacagtccgactccggctgacatcagtaaccctaggataaagttgccaccaatgccgaccaataatttccaaccggatagccccgtcgcctgattagcaactcccagcaaactgatccaacctaataacttcgctgccatcagtaaagcagtgatgactaacgcaccggccatgattaactgaatccaccgctgattaagcttcgtcatgacttcactacccagtaatgcgccgagcgttgctgctaaaactaaactaatcagtgtcactggctcgaccgcaactgctgtaacaaagaaaaacgcctcaaacgcggtcggaatcgcatgcatcgtgttcaaagttccaggtagcttacgttcatcctttaaataatggctcgcttgaaaaattgccgtggacacgacgaaacttccgataccaagtgtgtcaagaaaatccgtcacggccccgataaccatgccgaaaccaaaactgtggtcaaaaaatggcgctgcttgccgtctggcaccggctaacagcaacccaaataagccgatgctgagcagcatcaacaacaccacaattgcaattaccatcaatctaaccccactctcttacctactcgtagcattatactgtatttttaggaaggaaccaaaaattattaccatgacgtcactgcaagtggtacccacaatcatcagtttgcatactgaacgtgaccaccagaccataagatcccaccggcactagggcaactatgcccacagattgtcagaatgtgctataatccagtcaatcgattgtgcacaatcattattagaacgtctccgcacttaatacttaatactcatcgcatgaaaggcggtaattatcatgaagacaaccacaattcgcccccttgaagaccacgtctgtttttcaacctacacaacagtccatgctattcaacgcctctaccaaccaactttgacagcacaccgactcacttatccacaatacttggttctagtcgcactctatgcgacaccgccgcgcgctgtcacggtcaaaacgttgagcacccagctaaatttaagtacgggaacgctgacgcccgtgctacagcgaatgacccaagctggtttaattacacgtcatcggaatccccaagatgaacggagcatcttgctcactctgacacctcaaggaaccgcaacacgacttgctttaaatgatttgccggatttattgactgctaagggtggtctcaatcaatccgagtgggcacaactaactcaattaatgactaagttaatgactaacctgacccgttaaataaccctgctaatattaggaagataaataaattaatttaaagccaccacgccgcccaatcctattttgtcgaaactcgaatcaccaaccgaataacactgatcattttgagccttgtcgaactttattattaaaatatcgttattagttcggattttgggcaaaaagccggccacaaccaacgatatttgattgtcatcaccattaatctctggtatgctaagtgcaatcatttagaatttggttgtttcaagggaggatttcaggttaatgcaggaaacaaagcaagcaacgaccctgaaccgttcactcggtttttggtcagcactttcactcgtcgttggtacggttattgggtcaggaatcttcttcaagcaatcatcagtccttgatagtgcgggctcaccgagcgctgcgttactcgcctggttactaggtggactgattacgttgaccgcgggcttaacaatcgccgaggtcggtgcccaaatgccgcatacgggcgggctctatgtctacatggaacaaatctatggtaaattgtggggttttctctctggttggatgcaaatcgccgtctacggtcccgctatcatcgcttcaattagcgcttaccttggtatattactagttggtttcttcaacctgcgggcgggttggcaggcgccactctcgattggcgtcatcgtcctgattggaatcctcaacatgttcgaaaaccgttggggcgccgcatttcaaattgcgaccacgttgggcaaattattaccgattgcggctattattatttttggactcttctatggtaatcagaatgcgctgggacagtctttacatacaattacccaatcaacgggtagtttcggggttgccgtcctcgcaacactttttgcctatgatggctggatcttagtcgctaacttgggtggcgaaatcaagaacccgcagaagttattaccacaagccattattttagggatttcaatggtcttgattgcgtataccttagtcagctatgggattctccacttcgtacccgcggcaacgatccacaaactcgggcaacaaacgacgctgtactttgcccaagcggcgtttggcacaattggcgggcgcctactgaacattgggattatcatctcgatggtgggctgtttaaacggcaagattatgaccttcccccgcatcgtgtacgccatggctgctcagaatcagctgccattcgctaaacaactcagttacttgcacaaaaaatcacacgagccgatcgccgcaaccattgccattctcgtttatgctagtattatgatcctgttcttcaatccagatcgcttatcggacctctgtatcttcacggtctactgcttctacgtggcaaccttcgttggtgtctttattttaagaaaacgacgtccagcttctgagcgaccattctcgacacctggatttccgatcacaccgctgattgcgattctgggcgcgctgttcgtgattatcagtgaaattggctcagacttatcgggtgtactgatttccttggttatcgtggccgttgggttcccaatctattattggaagcagcagcaaaatcaaaatgcttaatttaaattcttgataacttgtaaaagagcgttgttactgaagatattttcagtagcaacgctctttttatgcttttcaacgcgcattgaaataagtgatttaatttgcttaccgattaccttaacgcttagtaactaaacctcactatatttgattaatttgatctgctgtcgttctaaccattcctgcatttgaggatctgttaacattgcgacttcttgcgtccggggaactgtcaggcttgaatgttgtaataagtagtcatccaaatagccaggatgacaaaccatcatagcatagccgtcattatattgggctagtgccgcacgtttcaacgtttcataagggttatagtttttgcccatactttccataaaaacatgtaatacttttcccttaaatagcacactcggactatctgggcctgctgcaaagcgtaaaagatttaagtgatgacgttcacccacaatttccaatcccttaacaaagttatcactaactaccgcatgaccctcaaaataatcaggctggcgaccaactaacgctacaaatttttgatattgcgcttcgatttccaaaacaacttcattaagatcgacaaaatcatgaatagccgcccgataatccgaggaatgacgaaaggtaccatctggattagtgatgctcggaatcaaatttggatttgttaatggccggccagcagatataacagtatgcaaccctaagcaaacccctgcatctttaatcatggctaatcctgacatcgtcgttggcatattgaccataacacccacattattaattaacccgttgtgaactgttcgtgcaatcccaacattaactgcatcggaataacctaaatcatcagctcgaacgattacttttctttccattagcttttaagcctccactagtttaaattctttagtcccctgtttgtttgtattggcttcaacaccaatcgcataagttgcaatagcagctgctacaaacgcaatcacgccactaaccacaccgttaatcacattagatgtttgcccgccaacatacgcagttaaagataaaaagtttgcaacaggtaccatgacataagctgtaactgttgtcaggccagcatataagccaccgcaaaatccaccaatcatcatgccaataaacggtcgtttataacgaattgctagtccatataatcctggttcagtcacacctccgataatactagcgattaaataaccccaagcaagtgtcttttgatcttggtccttaattcgtaaggccgcacccaaacacatgcccgcgaccgacatactagcggcaactgcgccaagtgtgacaaagttttcatgacccgattgcgcaaaaatcatcatcatcgtcgtaagcattaagagatgcatcccggtcataaccaagatttcccataaggcaccaaccactccaaccgcgataatcgttggcaagccacctaatttcccaaaagctaatattcctgtacaaatgtaattgccgataaagtttcccgctggacctaaaatacataacgaaatcggcaacatgattgcaatcgtcaacgttgggataacaatcgtactaattgactctggtacataacgcttaaagaaccgttcaatatacgacattacccaaaccgacaaaataattggaatgaccgtacttgaataattaactaatggcattgcgataccgaagatattaaatgcctttccagcagtcacaattttaattaaattaggatcaatcaaaattgcacctaaaaacattgaaataatccgtgacgtattaaattgcttagcagctgtatatcctaagatgattggaaaaaagtagaatccagcatcaccaaccaacgtaaataactgatacaacgatgttttagtaccaagaacattgaacatgcttggtcctaaaatggccgcaaacattttaaacattgatgcagcaatcaacatcggaatcaatggtgttaaacatccagccaatttatttagaatcatatttcccgcagacttaaacgttaacttttctttaggtcgattatctaaatcttcattaattggcgcgtttctagttaaattccccaccgtaagtaacgcatcataaactttgctaactgcttgtccaataatgatttgatactggccaccagcgcgattgacaccaatcacacctggaatattctgtacctcaccatcattaggaatactttcatccttcaaattaaaacgtaatcgggtcatacaatgtgtcaccgaagaaatattcgcactaccaccaactgcttccagtacaccattcgccactttttcatactgtttatccttatttttcatgtcgcatacacctccattaattaacggttacgcttgagtatttattttattaacgattcttttaacatatatcattagatagaaaagttcatcatcattactattagtatcaagttgactatcaacgtagtctgcaattcgctttgctaccaagtaaatttcaggctcatcatgcctcatcgtattgaataatttagaattatcattttcagaaatttgctcatgtttcttcatccgtttaatgtaataccgtaaatgcatgacaaaccggttgtatgtgaattcggtttgattgattctaagctcatattcttgttcaataatttttgtgatgatttttatcatttcatcgtcgctatttacacttgaattggtcgctaaatcattagtctgagaattgacaaaatgcatggcaattgctgtgacctcggaaactggtaattgaatatttagccgtcgattaattaacctgacggcgtaatacccaacatccgtttcttgtgggtataattgctccacatcatatgaaaatggtaactgggcgcttttataatgggttagtcgcgttattgcaaagttaatatgatcagctaagctaaaaatcatatttggattcaaaattcttggaattagtgcctgcgctcgctcaacaattgccgcactcaaatcaaagatttcagtaggtatttcttttagtaattgataatattgatagtttaatttataaaatgtcatcgtcactttagtcatatcagtaagctcatacgggactttttgaaatcctaatcccttaccaaaggcgaccaattcttcaccatgttgatcaagacaaacgaccacgttgttattaattttcttcaccacccgcattttaattcgcactcctttacatagtttatgcttgctttaaaactggtgttccggctgctaattgttgatgaaacttactgccaagtggcacttcgcccgtataaccttctgtaaagacgactatggtggtcatatctaatcccgcgatcgccatcgtttggcgatcgagcgtcactaatagggtccctgctttaacttcttgatttaatttgacgtgtgccgtaaagcctctaccatttaagccaactgtatctaggccaatgtgaaccaatacagacacgcccctagtctcatccatgatgccaatagcgtgtttactttcaggtaatgcaacaattttcccactaatcggtgccacaacttgattagtgtcctcactcggcctaatagcaaatccatcacccatcattttctttgcaaacacttcatccataacggccgtgatcggtatacaaataccttcaatcggtgtaaccacctcgaagacatcaactttctttcttttaattccaaacatcactgaacctccttcaatacaaaaaaactccttgaggcacccacttcacccgtatatttcaacaagtaaaaggtaatgcctcaaagagtatgagttacaatccttaatttcagttttatagaaaacgttttcattaactatattatcacgccttctattttttgcaagacatttaaatattttttataaaaaaggccaaacaaagcattattgcttgtttggtcttttcattaaggaatttcagccatcatcccaccagtttaattacgctaacttcttatccaacacacgtgacagaattgacaaggcgtaacaaataatgaagtacatgactgcgatcattaagaacatcggtaaaatatacgctgagttctgaccataaataatttgcgcatggtttaataattcaggtaaaacaataatggttgccagcgacgtatccttaatcagtgagataaattgactcacaatcgttgggatcgtcttcttgattgcttgtggaaagacaatgtgccataacgcttgtacatagctcattccgttagcccgggcgccttccatctgaccgtaatcaaccgccaaaatccctgaacgaatgatttcggctaacatggccgattcaaaaatcgtcatagcgaggatggctgcgaaaatgatcccaggcttgaatcccaagtgtggcaagccaaagtaagtaaagaagataattaagatcaatggcaagtttcgaataatgtcaacaacaaacccaaccactgccgataaatatttaatcttgacgtaccgaagcacccctaggactgaaccgataataaaactggcaatgatggaaacgacggacacttccaccgttacccagagtccttcgagcaagaaccggatatttatccacgaatacgcttgaataaagttttgcatgaatcgtcgcccccttctagtttgctaattttttctctaagtgccgcatgtaataactcagtggcaacgtaatgattaagtaaaagacccctacgaccacgtagctattgatcgtatcaagcgatagtgacgcaattgaatttgcttggtacatcaagtcgaacccagccacaaaagctaggacagaagagttcttcaccagattaataaactggttgcccaacggtggaatgatgattttaaatgcctgtggtaagacaattttactcattgcctgccagtacgtcatcccattagcacgggcgccttccatttgtccaggatcaacagattgaattccggcccgaaccgtttccgcaatgaatgacgaggtatagattgttagcccaattgtccccgcggtaaaaccatcaatcttggcaacatacattggaatgatcacgtagaagaacatcgcaataactaacaatggaatgttccggaaaatttcaatataaactcgaccaatgatgcgcatcgtacgacttggcaaaacttcaaagatagcaaacattgttccgatgatcgtactgaataccaaagcaatcacactggataacaacgtatatccgagtccttgaatcagctctgaccaatagtgcgttagcatgtatcccattagcgtgacgcctccttatagtcgaagccggccacgttaccaaaccacttcttcaagatgcggttgtacgtcccgtccgcttcaatttctttgagcgctttattcagagccttttttaacggttcctgacccttattaacagcgatcccgtatggttctttcgtgaaagtacccccaaccacttcgtaccctgggttttgcgacgccatcccgtaaagaatcccgttatcagtagtcaacgcgaccccctgaccagatttcaacgccgtcattgcctgagcatagtcggataattccaacaccttagccttaggcgctgctttcttaatgttctcaacggagtttgcaccggtcacaccaaggaccttggtgcccgacttattcaaatccttaactgattttatggcactgccctttttaaccaacagtgattgccccgcatcaaagtatgaattcgtaaaatcaacctgtttttcacgttccggcgtgatagtcatcgtggcgataatggcatcaatgttcccattcttcaacaatggaatccgcgtttgactcgttacttggacaaacttggcggtagcattcttaccgagcacccgctttgttaatgccgtcgcaatgtcggcgtcaaaccccttgatttgattatctttaacgtccatcaacccaaataatttcgtatcagctttaacaccccacgtaatcgtcttactagctttatcattggtcaaaacatcctgttttgctaatgattgccgtgaaccgcaagcggttaagaccaccactagcatggcaagcatgccgagtgcgccaattagtcgtttcagcttcttcattcgtggtcctcccctacaaattagtgtgtaataattttactcaagaattgacgggcccgttcattagacggctgaccatcaaagaacttttctttagcatcatcttctaggatttccccatcagccatgaaaataacccgatcggccacttcacgagcaaagcccatttcgtgggtcacaactaacatggtcatactggagtcttcggcaacactcttcatcacgttcaacacatcatcgatcatttcgggatctagtgctgaggtgggttcatcaaacaagagacacttcggcttcatagctaaagaacgtgcaatcgcgattcgttgtgattgcccaccagataattggctcggtaagctattggccttgtcaaccagaccgacactatctaataagtccatcgctaattttttattctcatcttccggccgtttcaagactaaccggggagcaatcatgatattttcaagcaccgtcttgttagcgtacaaattaaagtgttggaacaccatcccaacgtttttgcgaattttattcatatccgttttgcggtcggctaaatcaaacccattgactagcaattgacctgactggacacgttccaaaccgttaacggttcgaatcaaggtactcttacctgagccagatggtccgatcaaaacaactttttcaccttcattaatcgttaaattaatatttttgagggcgtgaaaatcaccataatacttttcgacgtcgtgaaattcgatcattgacattgcagtcaccttcgctttctctatcagcctgttgactgacggtctagaattattgcattaataattagagttaagaaatccttattcttcgttaatgctatttaaatagtttaatacataattagtaattttgtcaaaaagtagctaaatattgttcgatatccataaaatagtgataaacagctacactgttttcagttaaaatagctgaataacagctccaatattgaacattattcgtgaaaagccaataataattcgcttttctttttggaactgccacggccgaataatttttagacaatgatttcaataaaatttatattattctaacaactaaacttaacccgcttttaatcataccactactgaaagccaccgaagcgtccggcgcataattttcacaattagtggttttaactaactgaactttaaaaattgttaacgcttccgcaatcatttctttaataatcactgctaacctagaactattaagaaattaatcatctgcattgtaacgggagacgataatatgttacttgaccaagcagctaacatgactaacattatagcggcccagattatcaaagtcttttatccctttgtgattgtcaagactgagacgggggcctacttaaaattgaatttatccaccaatgaacaacgcgatccactcttctgggatgagctccgtagcattctgcaagctaaactgtgggtgccaatcggtaagcactatcaccagttattagataatggctggttagccgaatctactagctagttagtcacgaccagtcagccgactcaagagacaaataagccctccaagcaatatgcttggaaggcttatttcattgccagtacacctgaagcccagtcgcggacgcaccaccaaattagtcccgctataagctagttatcgaacagcgagtcgccgaacaagttaaccggtggggcactttgaccagccaccgtctcctacagccatactggtagtagcggctgacgccatcattaaaaggcgtgggccgtcgtttcaccatttagaattgctaagacgtcatccaggctaatatcgaccatgtttttgaccgctaaattcgtatagaaacccacgtgtggcgtgataatgacgttgggcatctgcattaattgtgccacgttggtatcttgaagcacctcaccctgatgattttggttaaataacgcattttcaccctcaaccgtatcgagtgcacaaccggcgatttcaccggcctttagcgctgccacaagatcatcggtgacaatcactggtccgcgtgaggcgttgataaggtaggcatccgtcttcattaacttcaaggctgccgcatcgatcaaccccgcagaggtctcattcaaatccacgtgtaaatcaacgacatccgcctgccgcaataggtcttccttagtgtcaacgtaggttaaaacgtcttcgagttcaggatggcgtaccacgtcataggcaatcaccttggcacctaacccgtggaaaagtcgagcggccgtgccaccaatacgacccgcaccaataataccaacggttaatgatcgaatttctcgtgcttgcagtcccgcccactgaaaattctgttggctgattcgttgatcaaacatttccaagttgcgaatcaagcgcatggtttgtgccaccgacatctcagcaactgaattaggcgaataggctgggacgttcgtgaccacaagaccagccgccttggctgccggaatatcgattgtatccacaccagccgtacgactcgttagttgttttaacccggccgcagctaatgattggtataagctagcatcaccaccaattggactgcgttgctgaatgaccaagccgtcataacccttgaccaggtcggcagtttctggatggaattccagatcattcgtatctacttgaatttgatgagccgcagcccacgcttgaatcgcatcctgttcatcatcgcgaacactatacattaaaattttcatctttaagccccctgcttcttgctggcaacgtacgtcctgagccgcgtgaccgccgtcttaagatcggccattgaagcggcataactaattcgaacatagccttcaccacccgggccgaatgagctacctggaatcagagcgacacgtgcttcatgggctagttcacggcaaaaagccatactattttgtggcaacccggctggaatcttactgaagagatagaaggccccttctggcttagctgattggaacccaaggtcattaagtgcatcatacaaataatcgcgccgttcttggtactcacgtttcattacttgggcatcatctaacccatttttcaatgcttccgtcgcagctgcttgagcattggtcgtcgttgaagtcactgtgaattggtgaatcttacccagttgtgctgtgatagctttcggcgcacacatgatgccgattcgccagcccgtcatcgcgtgcgactttgagacgccgttaagcaaaatagtttgtgttggtaagtaatttgcaatcgattcatgaggctcaccatacgtcaattcgctataaatttcatcagacaaaacaaaaattggttgatcagctaacactgcggccagggctttcagatcatcatgccggtaagtcacaccggttggatttgaaggaaagttaaggaccaccgctttcgtcttggggtgggctgctaacgtcgtttgtaactggtcaggcgataacacgaagccattgtccgaggtatccatgaagactggtgttgccccagataatttaacgattgcgatgtacaatggaaaaattggggttggaatcaggacctcatccccaggattaaggattgaagtcaacgctgtataaatgcccccggtcgcaccagctgtgataatcacttcgctagcaggatcataatggacatcatacttagcggccaagaattcagcggcagccgtccgcaaggccaacgttccgttcgagggtgcatagtggctttcatccgcttcaatgctttcgattgcagcttgtttcacgtgctcaggtgtattaaaatccggttcaccgagggtcaaacgcacgatacccggaatatttgcgatttcagcgttgaacgccaaaatatcagacggctgaatcgccgcaatttcatgattcatatggttaacaagtgtttctgaattaattgacataaagattcctcccaagtttggctgatcttgttggtggaagcggactggactagggtcaaaaaagcgcacccctcgaaattccaaagggtgcgccaccacgcagaaacaaacttattagccacccttggaattttcaaacatccatgggcgccgtcaaatcacaaaatactcttggcaaccgcatcgatgcaaacatcggattcgtgtttgcacctctgcagccggcacaaacactagcgaaaataccaaaagtaaaagctagttctagattttaatgaatttaacggtaatgacatatcattagctcctcatcaattgttaatctaactataatggttgtcctaaccactgtcaaggacgaatttgctatactggagttaaatctactttggaaggaacgattatatgacttaccaagcattaatgtttgatattgacggcacgctgactaatagccaaccagcttacacgacggttatgcgtgaggtacttgctacttatggcaaaccatttagtcctgcccaagcgcagaagacttttcccatggccgctgaacaagcaatgactgaattggggattgcagccagtgagtttgaccactttcaggcccaatacgaagatgtcatggccagccattatgatcagattgaactttatccaggcattaccagcctctttgaacagttgccgtctgaactaagacttggaatcgtgacttcccaacgacgaaacgaattagaaagtgggatgcgctcgtatccattcatgatgcggatggctgtcacaatcagtgcggacgatacgcctaagcgcaaaccagatccactccccctactcacagccctcgaaaaagtcaacgttgcgccacaaaacgcactcttcatcggggattccgtcagtgacgaacaaactgcccaggccgctaacgttgattttggactggcagtctggggaatggaccctaacgccgaccatcaaaaagtggcccaccgcttccaaaagccattagacattttagcgctttttaaatagccataccgacaaaacaaccgtttcgagccactgctcaaaacggttgttttgtgtttagattcaatttggctaccgaaacgtgcttccaaaggcagtttgctccgcttaacaataaaacggtgatcatccaaaaccaggatgatcaccgttttaccgttaatgctcacaaactaaccgcctttggaagcactcttaatcttctcttccctcatacgcaacctgcgcggttacctggtaatcgcccggttgctcgatagccgacgttcggcccgcaatcttgctcataccacctgtgattaccgtggaggccaagtacaacttataatcctcatgcgcatcatgaacatcggtcaagccgaccttagtaatatgcccaaccggggattggtccatctgattgattccggcgtaaataactagccggtgattctccaactttaactgcgaaaaaggaatttgaatgccttgcccaatcgcataaacgggttcacccgttgcctgcgcctgctgaatgatggcatcatcagttaagccaccgtaatctaatcggacaatgttcgccgcttgtagttgatcaacaatttgatgcacattctcctgttcagcacgtgaagtcttcaccgtggcgggcaacaattcctgcccatcaaaaataccgttcgcaggaatgtatggttgttgctgactttgttgtgcttgtttttcagctgctaacgcttctttaggcttaccacccaacaatttttcaatacgtggtgataagtcatacttcgcagttttattagtaaaataataaatgacgtttaacgtaatgaaataaatcagcgccaagaaaacgagcatatataatatgccccgtaaccacgcgccattctgcatcaagcgaattgccacataaccgaggtataaattacccgcaattccaatgccgatatagatttggttcttaatcttcacattgacattaacgtaacccaaggcgtggttgatcatatctaaaatactaaacattcgttattcgcccccgtcgctagtagtggtatccgtcgtcgactgtgacgttgtcgttgtcgagcttgacgcggtcgtacttgatgactcagcagcagagctttcatcatcgtcactcgtatcagtcgttgaactattgttatcagtcgtactactattagtggcactagaactcgtatcatcagctgaacttgatgaactactggtcttattagcactgctgctgtccgtatcattctcgtcagtactactactggaactactattctgttcatcattagatgtatctgaactggatttgtctttggatttattctcatcgctactatcatcagccgctttctttttcagacttgcggaactagctgatgaacttttgaccacactgctagtggccttggcgccattgacagtatgggttgtcttattaacgaccacgttagttgcccccagtgcaaggacaattgaaacaattgcaaatggtgaaataaatggtggtgttcgataagccatcgatgtcattcccttctgaggctttgccgttattctttctaatctataattaaaccatgctcgtgttcggaatgcactaattctatcacaaattaagaaactctttactcaaacaaggccaacaaaaaagccgactccccgtcagctattaattgcctgctttttcgtgcaattggcacatagaccgtaaatctcgatgcggtgacccgtaatcgtacaacccggtaattgtgcttcatactcgtctaacggacacgcttgcagttccgtcaccttaccacagtttgaacaaacaaaatggtgatggtgttgatgcttgaaatcacattgatatttaaccagggtttgattagcctgggccttcaattccaataatcctaacgtttcaaactctttaatattgcgataaatggtattgtgactcattcctgcaaataaggtccgcatgtgctcatcaacggccgaaattgccacatagtggtcctgataggtcaccagataatctaataatgcctgccgttgcttcgtaattttaaactgattgcgacgtaaaattgcgacggcttgttcaattggtgtttccataatgttgctgcctcctactgaccagggcttcactaaatcataatcattactatttagtttagcatactcaagtgtaaaagtgaattacgttgaccgtctatacgtcagcgctaatctttcgtcacaacatcatgctgacaatattcagtgaccagctcatctagttggcgccgcgtcgcctgccaatcatcattcacgataacatgtgcatggcccactaatcctactggcaaagcctggtcccgcaaatactcatcactagcaactcgcttttttatccggctaggaagatctcctcgcttggtcaaacgctgaattagcgcctcttgatcagcaacctcgagataaatcaccaccgcttgttcgcccaactcccgcgcataggtaatagcccccgccgtatctaagacgatactaatcagtggtgaccgttcccaggctgccgctagtccttctcgtgaagaaccgtattgattaccactataggtcacgtgttctaaataatgtttcgtgacaaaactcgccggagtttcaaaataatagtcgcgcccactgacttcaccttcccggggagcccgggtcgtatgagtaatcacctgaggaatttggtattgtgaccgcaagtaatgactgacagtggtcttaccactccccgttggtcccgtgatcacaaagatccgtttcgttgtcaaagttgataaacctccattttttaatccatgtaaagcttttcatttgcgttagctcggtaaaccgagtatagtaacgtacctataaggttcaaatagatgattcacgcatctcgtagcaaaccaacaattttcagaagggagttttgtcatatgcaatttcaaaaaacaaatagctggttcagcattgtcttagatacgcaacgccaaatgtttgtcgcaactgacaaacttcatccagaattgttcgctgaaggcgtaacaatcgaagatgcagttgcaaacttacaaacccaggcctaagccaatctaaaaatattgtttaaaaattactggtaccgtttatgcgacggcaccagtaatttttttacagtcagtattattgtagatgctgctcaatgtaggtgttagcctgatctaacatttgctttaaattatcgtaagtcaatcgttcgcgggcagcagcataatcaaaccagccaattgcactgatttcagcttgctgccgcgtcactacgacaccacttggaacttcactgacaaacagtgtgacttgcttcaaattaccattcggtaagtcatattcggtatacgccttaaaattggtatcgagtgtcgcttcaatttgagtttcctcacggatttcacgtcgcgccgcctcagctaacgtttcattgccttcaacgtgccccttcggaaagccccaaaaatcactggtcgcactctgtaataataaataagcgggatgaccatctttttgttgatagacgaccgcaccactagctacttctgtactcatgaagtcgcaccttcctaattatgaattatgctctagtataacatgttccatcattaattgagggctaaaattgcctggagcaagtcccccagtgcgaccccttgccggtcatccgttcgattttgtgcaatcgtttctgctactgccatattcaaccactgattagcgcgcgccagcgttggtgctaacgggtaaccccggcccaacagtcccgcgattacagcagctaaagtatcaccggtaccattataatgccccggcaaacgtcgcgcaccacagtattgcacgtgcccagcttcatccaaccaggcacaaccaatctgatcagcacgttggacatccgtaatgactgcgtgggcgccagtttttaactgtgcttgcagtgctggcaaaataacttctaaatctggcgtcacttgatagggcgctcccgttagcaatgcggcctccgtcgtgtttggcaaaatcacatccgcctgttgaataagctgacgcattgccgcgacatagtcctgatcaaagccctgatagagttgaccgagatcgccgagtactgggtcaacaactaatagcgacagcgtttgttgttctaagtaagtagttatctgttggcacagtgcgaccgaaccaacgtagccgatcagggcttgatcaaaatgcagttgtgcacgggtccaatgcgcaaagacctgtggcagccacgtcgataagtcgacaacggctggtgtcccgtacccgctagtatgtgtcgataataagctggtcggcagtgctgccacgtcatactgcatcgccgttaatacgggcaacgctgaactaagtgagattccaccgactgcggataaatcttccgccactaacattgttgacaatcttgctaccccctcttatctcgtgtaatgcttattctatcagaactccgactgactgtaacctcttcgcttcaaaagaaaggttaaatcaaccactcaaattggcattgattactcatcactgcaaaccgcaacggtattgtcatcattaagcttgattagtgacgactcaaaaagttgagcagcggattgccagtcccgttgttcaactcattaaaatttatcatccatcctcatcagactaagcacacattacgtcaaagcccttcgacacttaaccgacttcagttctttcaaatattatccacaatattagctagcctacaatgtgctagtgaatcctaacgtgggcatccgacagtttcagttatcagatgacgttaaatattgctgttccatagtgtgccgggcccgaaccgcatcttcaaaatgcgcaaaatgtttgtttaatatgtacgttcctttgtagtagaagtgcgcaacccaggaacctgactgtttgtcatagctcacgcccacgaccccactcgtgttacgcttcgacttcttgattgaactcacatctgtatggtgatcacgaatcttcaaattgcgcgggtcccccatatgcgaaactgcttgcggattattaaaaatattttgccgactctgttccacggctagacagccacaactacgcgtcttgccgtgccgcaaaacgtaggaatccaccacgcacgtccggccacactgacactgacaaaaccagagcgcattaccattcttggcccggcccgctcggtgaacagctattaagcgtccgaagtgctgaccggtaatatcaatcgctgctcccatcctaatcccaccattctaaaattaaatttctattgataacaatattataagctttggcgaatccaattaacagtttaatgtattatccgtgtgtattctttgactaccgttcgttataacaaagtatcaacttataaataacaatagtaacagctacccaaccgcatattcagacccgtttctcttcagcttagcaccgttaccgccggcttaagtgatgactagtaattcggccatcacaacgctttttaaatccccaccatgactggttacgcgttatcgtcatcaaatctattgtcagcacgaacattgcctcgacagtcgcaatgtcaccagcttctatgatgattaaccagctatcttgctccgtatcccattgagttattaataataaaaggctgattctaattgacttttaataatcaaccacggtatcatattgacatgacgatttgtcgataatgacaactaactgttacaaataaccaaaaaggtggtccatgttatggggattttccagcgcattttccaaaaagaagatttggagcgctatttacaaaaagatagtcattttgaacgaaccctctccgcagtcgatctgattgcacttgggattggtgccgtcattgggaccgggattttcatcctacccggaacggttgccgcaacaaaagcgggacccgggattattttatctttcgttttggctgccattgtgtgtgccgtcgccgcaatgtgttacgccgagtttgcttcggttctcccaatcgccggttccgcgtattcatacggaaacattgtctatggcgaaatgattggttggatcattggttgggctctggtactcgaatacgtcctagccgttgcgaccgttgccgttgggtgggccgcgtactttaattcattcattgctggttttggcctcaagttaccgaaagccatcaccggttcgtttgaccccgcccacgggacctatatcaacgtggtcgcaattctgattgtctgtctgattgcttggattatcgataccggcctaaaaacgtcgattcgattaaacaatattattgtggtcgtaaaattagcaatcattgtattgttcttattagtcggttcattttatgttaaaccaagtaactggacaccctttgccccatttggtgggacgggaattctcaagggcgccgcggtcgtcttcttcgcttacttagggtttgatgctgtgtcttcgtcggcagccgaggttaaaaatgccaagcgcaacatgccgattgggatcattgggaccctagtcatctgtaccatcttctacattctcgtttcaggagtgctgaccgggatggtttcgtacaaacagttgaacgttgacgatgcagtggcgttcgctttacaactcgtccatcaaaacttcgttgccggtattatctcgattggtgccctcgccggcatgttcacaatgatggttacgatgatctacagtagctcacggctattatattcaatcggccgtgacggcttactcccacgtttcttaggtaaaatcgataagcaccacgcccctaaaaacgccatgttgacggttacaatcgtgatttcaattcttgctggtctcattccgttagaccaattggcaaacttggttaatatcgggacattaattgccttcgccttcgtttcttttggaattttgctactacggcgtaatcccaagctcaacgcgatcaagggcttccgcgtgccactttacccggttctcccaattatttctggcttgctgtgcctgttcatgatgacccagctatccatggaaacttggctggcatccctagtctggttcctccttggtctcatcatttactttggctatggcattcggcatagtcgcatgaataaagctgatgagtaacaatctagatttgtactaactaaaagcgcccatctcaagtgatcaatcaacttgagatgggcgctttaactattgtcagccagctaacgatgacaacgattacattttaaggtatgataatgatacttaattaaggagcgtggtttaatcatgttaacacctaaaacgatccatgacgaccttcatgagcatcatacccaggtcgttcaactattcagtaagcatccctggctcattcccgccacaaccttattacacattattccagttatcgtcggcatcaacggcttttggaaatcgcgagcactaagcaagcagctcaaaatcgaacgcgaaaaaacgaagcaacttgccctacaacaggtcgataaagttcagtcagcggttactaatcagcacccaagcttacgccaacttttcaagcaaattcgcagtcatcattaacaccaacgtggttcgaattggcagttttaatcgctgccaactcgaaccacgttttaatcaatccctgacatttttacaaactacgattaatgattactgcggccatatcacaacggttaagccaattgaatcgtcacgttggctgatggcccaacgagcttggcaacgggacaacgcgtttccgcaatcgcgagccaccgtgctgccgtttcagcatccacttccggaatcgtgacccgagcatctaggaaaaattggtacccaaaacggtcacgcgacatcttcaccgtagtcacgactttgctctgatgtgtctggccgtgctccttttcgattgcctccagcgtcgcgttaaggcatgtactgagcgccaatccgattaattgttccggattcgagcccggcaccgccttaagtggactagatacggccacctcaagaccattgggaatataggcgtgtccttcgatgccgtcttcattaactgcttgggtcgtatataaaattggaaaatcactcaatcttagttcctccattcgatagttcactttgcaattaacctaccacaacattataaacttgtcagtaagaagcattggttctcgactaattagcggtataatatttctaataatacttaatggggaatttacttatgaaaaataatcaatttgcaatcgtcccgactgattcggaaaccgcgattgccgaacttacgaaaattcattttattacgcctgatatggacgccctgacgactgttccagccgtctaccaggcattgctagctaaaagcttaccagaagtccacacggcaagcggcttgacccacaagtttaataacatcatggcaaccagccagcacactttatcagaatggctcgccgatgcaactatcgtgaacaatcaagtcttttataatgtgggacttcagttactgggttttctacctggtcaagattttgaattggccgatccattgctggcgatgcgcgatattcacttgccaatggtcggtgatagcgcctttgatcgtgaagccctctattatgcttggtacctattattaaatacacgtgggaataatggacaaaccttgattgaatcactcacgacccggggttactttgtaccattttaccaattacctaacgatcaaaagccactcttcttcaatggtaaggcccaagccgtctttgataccaacgcgctcattcgtgacgtcgtctacgttgaagcgcctttagatactgaccacgacggccaacgggacctgctcaaagttgcaatccttcggccagctgagaccgaaaccggcttaaaagttcccgttctctataccgctagtccttataatcagggcatcaacgaccaagctggcgatgctcaaatgcacaacgtagacgttcccctgactgcaaaggaaccggacgaaaatacctatgcggatgttgagttccagccaacaacggcgcaactaccagccgctcgaaccgcgaccacgacgaccgatacagcagaggagactttcagccgagaaaagtcctacacgctcaatgattactttctagcgcgcggttttgctgtcgtctatgcagctggaatcggttcgatcgactcggatgggctagcccctaccggtgacgttgatgaaacgacctcaacagttgcaattattgaatggttgactggcaaacgccaagccttcaccaatcgtgatggcaatatcgctatcaaagcttggtggtgcaacggcgccgttgctatgactggccggtcttacctcggtaccctcgcaactgccgctgctacgacgggcgtggctggccttaagacgattatttccgaggccgccatctcaagctggtacgactattatcgagataatggcctggttgtcgctcccgatacgttccagggcgaagacaccgatgttctcgccgctgaggtcttctcacgaagcttaaaagccggtgacgctcaccagatccaacccgcgtttgatcagaaactggcagaactgactgccgaccaagaccgagcaagcggtaactataaccgtttctgggatgaacgcaattatctcaagaacgttgacaaaattaaggcggacatcatcatggttcacgggctcaacgactggaacgttaagccccgaaacgtagctaatttatgggataaattacaggcagttcccgttactaaaaagctcattttgcaccagggacaacatatttatatcaataacttacaatcgctcgatttcaccgacatgatgaacttgtggctaagccataaattatatggtttagataatcatgcggagacactcttgcctaacgtcttggtacaagacaacacgcaagcccaaacttggcacggctatgacaattggtggcaagacacaaccgacgctttagattttaaggttcagtacaaagaattagttcctgctgaccatacagttgaccaacgcgccgctcattttactgataaattgcctgacaaattattcgaccactataagcatcatttggatagttggcagcgcgacctcttgcaagaggataagttaaatccgctctatgatcaccgcctcttgttcaagtcttggcaggcacctgaggatcaattattagtgggtattccgcacgttgcgggctctgtcgccgttaataagaatttcggcatgttgagctttatgctgattgacttcggggccgcgcgccgtttgactgtcagcccacaaatgctggctgcaaaagcgcttgatctaggttaccactggcgcgaagatgatttgaaggacttcaagttagcgggtgagacgccgttcaagatgattactaaggggcatcttaacttacagaaccgccaccacccatggcacgcagaagcgattcagccaaatgtcttttatgacttttctgtggatctccaaccgctgttccaccacttgctgaaggggcatcaactcggactagtcatttacgcaactgatatgaagatgacgattcgtggcaatcaagacctacagtactcacttaacttgaacgatattcgcttacacgtcccaatgaaaaaaataacagactaactaattatggcctaccaactaaccacacaaccgttaactggtgggccttttgtgtaccttcaacttaaacagccacttatcatgaccaggtcggacaccaccacctgtccggaactagccaaaaaaagttccagcttaccatcaacgtaagctggaactcatctttaattgttattaacttcggcaatgcggttcgcaatcaaattcgttaactggcgattaccagtcgtatttggatgaacattgtcatctgcaaaccaaccactttgattctgcgcacgaccatgccaatcgataacatgcacgttcgcatgcttcttagcagtcttggcaatttgagcattgacctgattttgccaactctgtgttgggacgtgggccgttacccagaaaatctgacgatccttaccaatcagtttaacgacttgttcagcttgatcatccgtaattgtcccgttagtcccaatgttcaataggacgttatgggctaattgcccttgcgacttcagcgaattaatgattccaggaacttccgtcacttgacgaccaacgcgaccttgaaccaccgtacccgggataacatcttgaagatcggaagaaacatccagtaacaccgaatccccaatggctgtcagatccgtattggccatcgctagaacaacttgtggcttcaaatcgtattccttttccacctgcttctgcttcgagttcaacttcgcttcagcctgcttggtctgcatcttttcagtcgcaaccttcttgcttgaagcagccgctgcctgggcagctttttgccgtttgagcgccgccgcattcttcttatcagccgctttagagttagctgcaatcgtcttttgtaattcagtcttcttgttagcttccgctttacttggctgttgaacgaaaccaaccgccgtaataacgaataagaccgtggtcaaagcgacaatcgcagtggtcacgcggttaaacttcggtttgcggaggaaatctttgaagtcgaccaataaccgactgtaatcatagtgccgcattggattttcaataaaccgataactcaattccgtcacgatcaaaattaaggcaacttcaatcaaactattgaggagtaaatgatcaccaatgtttttaactttagtttcgtagaaaatcatcactgggaactggtagagatagatcccataactacgttgcccaacgtacttaaacaacggattcgtcaagacgcgattgagatgactagccgggtgggccaccgttgcaactaacactgttgataggactgtgaatagtaacataccgccacgataagtgaaatcagattgaccggacatctggaaaaacatccaaataattgcaattagcgaagcaccgcctaagatatccagtgtcactcgattaacattagcgatatccgccgataattcccgtgatggccagataaacgcaaggccagaacctaacaagattgcaaacatccgcgtatcagttccgtagtacacccgattcgtattcgctggatcatacaacattgccatggttatcgctgaaatacccgcagcaatcatcataaaccagaagacccgtgaacgcttcttgaagatgaccatcaagataccaatcactaatggccagaataagtaatattgtccttcaattgagagcgaccacaaatgagtgaacggtgattcaccattgaaacggtcaaaataactttgaccgtgattgatttcaaaccaattatagacgtagactaaattcgttaatacggtagcccgaatgttcgtcaataatgaccgttgaaacagcgtaatgtaggctgttgtccctaacaacatcgtcacgaatgctggatatagccgccgcatccggtgtccgagaaaccgccatatccggacatgcccccgactcaaaatatcttgtaataaaatatccgtaatcaaataacctgaaacgacgaagaagatcggaactcccaagtaacctccttgtagtgaggccggcatcaagtgatagatgatgacacccagcaccgccaatgtccggataccatcaaatccggtgatataacgtcttggattcatccggtgtcgattcatccgactcattgttcggctcatatttacgctccgcaaattttcattcatattcctattaccccttgaattgtctctacaaatattaactaacccaccagtgcttcggtacctttactataatatgtaaatgaccgcattgaccagcattatttaaacttcattaattatttttattaaccactttattcattatgctgattaaacacatataaccccgaacttaattacaatataaataaatcaaacgtgagtctattaatccatccgttatcattcctatgttatcaacaatttaaggttgattcgacgtaccaaacagctcaattaatcaaattgaaattgattagcactacttgtgactaacttctactatacaacagtatgaaccagtaaaacattgaatcagaaatcattttaaaagattgacgcgattcgttcggtaacttgataaattgattttacaaacttgctagccatgataaccaccggacaagaggttcaccttagtaatctcaccagaactaaaatgacggctctgaccagtctctaatttgacgactaacgccccgtgtgcatcaatatccgtgacgactccacgatacttttgtgttccgctcttcaactcgacctgttgatcgatcaccatggagagtttccgataagcgtccatgaaagtcccactacgataagtcccatagctattgaaaaagcgccgcagtagctcacaaatcacttgattgcgcgtcacaccatttggattggcaacgactgcgcccgctttgtgcgctagtagcgctggaaaagctgtcgttgttaagttaatgccaattccaataatgactgctgaaatttgccccgtttcgagactagtgatgccttctgataagataccaaccaccttgtgatgattgactaacacatcattgacccactttaatgaaacgtcaaccgcaaacagctgttgcagcgtctgagcaacgactaccgcagtactcgttgtcaacaaaccagcgtctaacgccttctggtcactgagtggtaacccaatgctcatataaattccagtctgtgctggcgaataaaatgcccgccccgaccgaccgtaaccagcagtttgcgtatccgcaaccacgattttcggaagtgctaaaggcgtctgcgtgactaaccgccgtaaataggcattcgttgaatcaaccgttggtagcacggtcaaatcaaacggtggtaacgctgtaagcgcgtattcaatcaccggcgcactcaattgattattggccacataccgataacctcgcccatgccggctctcaatagtatggcccgccgcttgcaatccttgcactaatttccaaatagccgttcgactgattgcaagtcgttgtgccaaccagtcacccgaacagtacgcgggcgccgcttggattaacaagcgtaaaactgcgacttgatttgccatatcaatctcacccatctctaattagttaacccattatttcatattggttaactaaccgcaattgaatttaaagaatgtaatattacatctttctgtgctgagcagtttacttattatcgctgaaaatgtaaccgcttgtcaaatcaattgtgtacaatcggtcacaatacgactgaaacttggtctatcagtcgtaccgaccagcataataactagtataaaccaaattcagactaaacggcccgttctaattattatttttatatcgtttcgaccgaagtcccctcccatactcagctactatgacgttaacgtactgattcagttaattagtgaacacgaccttaccaattatctacttaatgcaattctttatgattgcctagtctctttgaccctgcttagttaacagtggtaagataacaattaaaatatgaagaaattaggtgatcatttgaaacaaggaacgacaatcatcacgctggataatggctaccatttatggacgaatactcagggcaaaggcgacattcaattattatgtctacacggtggccctggtggcaatcacgaatattgggaaaactttggtgaggaactggcagatttaggcgtccaagtttcaatgtacgaccaattaggatcctggtattcggatcaacccgactactcagatcctgaaattgctaagaaatatctcacctacgactacttcttagatgaagttgaagaagtccgacaaaaactaggactcgataacttctacttgattggtcagtcttggggcggtgccctcacaatgatgtacgcgctcaagtatggtcaacacttaaaaggcgccattatttcaagtatggtcgataacattgaggaatacgttgtcaacgttaacaagtgtcgtgaagaagccctaccggctgacgctgttgcttacatgaagcaaaaggaagcggaaggcaactggaatgatccccaatatcagaagtacgtggacgttctgaacgctggctatgttgaccgcaaacaacccacttcaattcgccatttgatcaacaccactgccactcctgtatacaacgcctttcaaggtgataatgaattcgttatcactgggaagttaaaggaatgggatattcgcgatcagattcacaacattaaagtgccgaccctgttaactttcggtgaacacgaaacaatgccattagcttcggcccgccgcatggctcgtgatattcctaactcacgcttagtaacgacgccaaatggtggtcatcaccacatgatcgacaacgcccccgtctactttgaccatttgaaacaattcattcgtgacgtggaagatggcagctttaatcaaaaataaatcctaactgaacaattaagaagccgccagtatcaggtcatacccgatactggcggctttttaataatattaggttaactgaagctttgcccagtggtctaactagcccttcaggctttaactatagctgatcaccctgtgctcgtagtaaggcgcctaatgatggctgttccttaatatcaatgtggttggctttggcataagcgtcaacttctgcttgaccatataattcaggatctagtggcatgtaagctgtgccaattggatcatcattcttgatgaccgcgttcacaacgattggccgcttgttgcccttcgcttggagcgccttgatttggtcaaagacggtttcgacctcttgattattttgaacagtaaaaccaatcccaccaaggccatctgcaactttggcccagtcggcatccgttagatcaacaccatacaagtgttgcttcgtatcaacttgctcacgatagatgaaaccaaaccgttgattactgaaaatcacgttaataacgggcaagccgtaacgtgcttccgtgataatatctggcgctaccatcgcaaagccaccatcgcctgagaaactccacgcttggctgtctggaacacttaaggcaccagccatcccagcaggtagtccaaatcccatggttgcgaagaggccagataaggcaaagcgttgctcctgatccattgggagcccccggacagcccattcggagacgttaccggtgtcgaccccgtaggtatcacgagggccgaccatactagcaactttgtgcatgaccgcttccggcgctagtccatcatggtcgtcagcagccaattgttggagccacttatcccaattacgtttattttgccggttagtcgttaaccacgctgtttcaggtaacgtttcgccagttgcaatcatcgcttgcaaataagcttgggcgtcactgatgacggcgtaatcgattgggaccatcttgccgatatcaaaactgttattgttgacctgaataatcttaatccccttaggccaaaaactagcaaatggaaattcagatcccaggaacaaaatcaaatcagcgtgttggagtgcttcgaaccccgatttggaacccaaccggccaaacgtgccaattgcattcgggtggctcgttggaataacccccgtcgccgggaccgtattcatgactggaatattgaattgttcactaaacttgaccaggtctgccttagcaccaagaagaccccgaccagcgtaaactaatggatgcttagctgcttttagcatctttaacgttgccgtaatggcctgaggatcgacccgttgttcaaacgtatctgaaacggtgttaggcgtcgataccggctgataatcgatttcttccgctgagagattttcaggaatgataacgactgccggtcccttttgccggtatgcttcacgaatcgcttggttaatgacatatggtaattgtccggccgtcgtgacagtgcggttatataccgccacgtcactaaacattggggtctcatccatttcttggaagtaattcgtgttcatcgtcgcttgtggtacctgtccgacaagtgctaatacaggaacgtgatccatcttggcatcatacaaaccgttgaataagtgcgttgcaccaggacccgcagaaccaaatgaaacgccgattttgcccgtaaacttggcatctgccgaggctgctaaggcccccacttcttcatgccgtacttgaatataatcaatatcggccttttcaaggtacaaaccttcaacggtatgattgattgaaccgccgggaatcccgtagatgtggtccacaccccacgcctctaaaaccttaactaaagcttgtcctgcaatcatctttgtcatcactattcatcccttcgacttagaaccaatttgtctgcttggttcaattcatttaacaaacgtattataaatcgctttcaattataaatgcaattaatatgcttacttttcgtaagtgaaattacaagtacacaaaacggggcaccattcagcgccaattttgtgtttatccgattatttcatgtgaaactatctatggactagaaaaataggatcaagcacacacccgatactcagttttatcaaatatcgctaacggtctagcacgaataacttaccgacttaacgacaatcaaaaaccaccccatcaaacagatcagggtggtctacattaagctttactatattgtgattgttgatgctgggctgagacagaactgaccacttgcaaagcacgctgctgccactgaacgtccacatctaataccgtggtttccggtggcaactggtatggcgaaataatttttaatgtcgtggtgactcgcagaatgactgcctgtcgataattagcgctaactaaccaacaacgataatcaccggccgctggtaactgctgttgccgatttgcaagttggatcgttctagtcaacggatcgaatgtcgcctgtgtcgcgtaagtgtaccccaataaatcattagcttgttcaatctgcccccgagcaatcagcccccggatccgagtagaactgactttaagctgctgattagccaagcgatccaccgtgaccgtttcaaagtacggggcgcccaattccgcgagttcgcgcatcccatttgcgccaccctgcccgaacgtatagtcaacccccgccacaacgacttgcgcattcaacccgacaaggtaatccttaataaacgcagtcggtgtcaagccagcaaattggtggttaaaatccgtaatatatagtcggtccacctgtagcgccgccatatgttggcttttttgcgcgacggtattcagataccgaaaagtggtctgggacttaaacagttgtgacgcgtgtcgattgaacgtcatcacagcgagtggtaaatcacgctgcttcgcaattcgtttcgctgtttgaatcacgcgttggtggccctgatgcacaccatcaaagaaacctaaagctaataccagtggcggttgtggtgccagcatctttaatcgatgggcatctaaattgattacttgcatctgtgcgacctcccgaacgttcacgtagtgttctctacagcttggtatgttgtcaccgccacaatggcaagcgacacttaatactatgtaccaaaagagccgcgataatcgcgtcctctttcgttaattatctatccaaattagtttgtttgagcttgttttaagaagtagctgaacggcttcaacgcttgagcatcatacttcttgacaaattcagcaatcttgtctttatcttgccatgcgtcatcgagatacatatgttccgttgtaaatggcattgcatgcgttaacttcacatcaatgacaactggcttatccgtcttcttagcgtcttcaagggcttgcttgaattcagccttggtccgaacggtataaccaacggcaccatagccttcgccaaccttggcccaatcagtatctggcaaatcgacaccagagagtggttgatggctatcatcagtctgttcagcttcaataaagcctaaggtctcattactgaagacaatgttgataatgtgcaagttatacttaacttgtgccaagatttcttctgacagcattgcgaaagctccgtcaccgctcaaactgtagacgtcccgatctgggtagttgactttagcagccagtgcagcaggaaccccaaagcccattgttgcataaatcccagaagttgcccatttctggtcatcgtgcattcggatcaagcgttcaaagttaatattaacattgccgacatcgatagcccaaacagctttgtcactagcttcttggttcaagacatcaaagattggttcggggcgaactggtgattcagtgctatcgttgaagctggcttgccatttgtcccagttctttttatcagcaaccgcagcgtcataaaaggctgaatcatcgcgcgcttcaccagctgcattgatcgccgctaaagcttttttcgcatccgcctgaatagcaacgttcgtatggtggcgcttaccaaatttttcactatcaatatcgatttgaatgaccttagccttcttattaaataagaagatactaaatgggacattgttaccgacccagaggattagatccgtactaaagccaatctcggcacccggcttaggtgcgactcgtcccgtggaacctaagtaagcgggataatcgtcttcaatgatccccttcgctaatactgaagagacaagtggcatcttaaacttttcagaagcagcttttaattcttcagccgcgtccttagcgccaacgccaaagtaaatcattggtgacttagcagctttgattaatttaaccgcatcagcaactgattcagcggttggtgcaggatagttaacagtgtgcacgctagcgttcgtttcaaagttgtcttcaatttcagcccaaccaaagtccttagggatcgttaagacagctacaccattgtgggcatacgcttgacgaatggcttcatcagtcatcatcggtaaactctcagcagtcatcgcagtccgattccaaacagccacatcgtcaaaaatcggttcttcattcattgcttggaagaagtccatgttcatccgcttagtaggaacttgtgcaacgattgctaacattggaataccatcttccttagcatcgtacaatccgttcagtaagtggacagcaccagggccagcggaaccaaagcagacgccgatctttccagttagcttataatcagcggaagcggcaatcgcaccagcttcttcgtgacgtacttggatgtacttcaacgtttcccgttgattatagatggcgttcatcgttgaatcgaacgacccaccgggcaaaccataaatatgttttacgccccacttctgaattacttttaatacggcatctgaaccactaattttagccattagtaatgtcctcctctgatatattttaattatcaactttacgactttattgtaatcacgattttttaaaatgtaaacgcttttatcgatagattttatctatcattagaaattttgcgaaactttctatggtttacaagcgttaacgacgggctttggagcgtttttaatttttggcagattgcaagaaataacttgaacgaatttaatgacgtaaattaagcaagaagatctcgattggtgtatgccaattaagacatttaagtggccgtgaattcaaataccagttgatttgaaccagttggtgatcacttagttcttcaatggcttggcctttgggaataaagcgccgcaaaactcggttacggttctcattactgcctctttcatgcggtgaataggcatgtgcaaaataaacctgtgtaccagttcgccgttcaattgtctgatagttagcgaactctttaccatgatctacggtaagcgtcttgagcttgtcttgaagttgactagctagttcaagtacggcttgagtcatggactgactgtcgcgaccatggagccgtttaacaattgtcaggcgactcttacgctccacaaaagtagccacagcttgacctttacgtttaccagaaagtacggtatcagcttcaaagtggccgaattcctggcgagtttcgactttatgaggccgctcctcaatggagcggccgtgattgaacgtaccacgcttttctttagcacgatgacgacgaattccatgatcaggcaaatcgggcaactgtatatcaagccatccttgatcaatccagttatagaccgtcttgtaggcaatccccaccacatgggcaacttgttcaggggaccacttctggacttgaatcttttcctcgatcaagtgtttaaggtttttagtgagcgaagacttccgcccccgttgactaacctttcgttcaaagtcagtttgcgctagcccagcctggtactcactatttagccggtgaagttcgttaaagatggtggtcttactaaagcctaagtagttagcgatgtatcgcaaggaacgtccttcattatgaagcgtttcaatgacaacacggttctggaatgataaaatagtggtgctcatcaaggtccttctttctaatggattgtgtggtaacaccattaaagaccttgatgggtttttctgtccacttaaatgttcaacttaaattttacaatctgccttttttaaaaaaaacgtatttttttgtatttttatattttgtattattttcgacaccggtataccaccttaaccaccgtactaattgtgtatttgtcttattaaatcgaattggtacgggtacatccccactcgttacgcttgccccgcttagcaaatctcggccgattgactgctcatgagctagtttcaagatagtttttgatgacggcgcttacatttcaatgtttatcctaactttctgattgcttcacctcccccttctatcacttgaatgactctagtatagtcacctccaaagcaaaccaacttgacgctcatcaagttttagcctatttcgcgtcaaaaaaaagactaccaacgtcatgtgcgtcagtagtccgtttagaattaagtcatttaaattatctgtaactagccaataacgtcgagctgaccacctttaactgtcagacatttaatatccacaagaagataatgaagatgaagaacagcacgtacattaatggatgaacttccttggcatgcttagttgcgaccatcgtaatgacgtatgcaatgaagcctaaagcaatcccatcagaaatactataagtcaacggcatcccgataacagttagaaatgcgggtacggcaatttcaaaccgttcccaactgatctgttttaaagattctgccatcaacacacccacaataatcaatgcaggtgcagtaacttgatccgtcacgacgtttaataacggtgagaaaaataatccaagaatgaatagcgcacctgtaacaactgcactcatcccagagcgaccaccgaccgcaattccggccgaagattcaacataagctgaagttggtgaggttcccaacactgacccaactaacatcgaagttgaatcggccatcaacgctttaccaacccgcggcattttattatttttcatgaatccagcctgttctgccaatccaactagcgttccggccgtatcgaagaatgtcactaataagaacgtcaaaacaacaataatcaattgtaacgaattaatatcaccaatatgaccaagcgccacaccaaacgttggtttcaacgaaggtgctgccgaaacaattgtggatggcatcttaatcaagccagttgctagccctaaaatggaggttaaaaccatcccgataaaaatcccaccgggaactttgcgactcatcaaaatcaacgtgacgatcaatccaaaaatagttaaccaggtcgttccaactgtcaatgatcccagaccaacaaccgttgatttgttggcaacaattaagccaccaccatgaagaccaataaaagcaatgaagaacccgatccccgccgaaattgctaacttcatatcccgcggaatcgcatcaataatcatttcccggagcttaaaaatcgtaatcaagataaaaatcacggctgcaacgaacaccccagccagagcagtttgccatttaatgcccattccgataactacggaataagtaaagaacgcgttaacgcctaatcctggtgcaattgctatcgggtacttagcaactaaccccatcaataaacagcctaacgctgacgctaaggccgtcgcggtgaagacggcgcccttatccatccccgaagccccgaggacgctcggattaacaaataggatgtatgccatcgaaacaaacgtggtcaagccagccagcacttcggttcgcattgacgttttcaattctgaaaaattaaaatatgccgcaattttattcatgattccctccaaatattcgcctaaattacaattgcacaattgtaaacgttcgtgttttagcgttcttttaacgtatttaatcgtatcattttgtttatttaaaagcaataaccgaacgctaaataattttgaatctatttaattgcgattttcaattttaatgagcctgcggtagaatgaaattgataaagcgtgttcattgccttaaaaccgctcttggtcctcacgaccctcaggcaaacaacgcgtcacgattctccatacaaaggtgtgatttaaatggctggttccaaaattacggcaatcttctttttaatcctctacgccgtcctactctacttggtcttcacaatgcagaacatgttagccatgtacttaatggctattgggatgtttcttgaagcttgcgaaggggtttaccataacttcttcaagcattgagcgctacacgtatcacagtgaagcaagtacgcccatttgagtgcttactttctatgaaacgaccctactttagtacaagtgtttttattcaatgggtattcgtaacaaaacagacttcttaagaattgtgacaattcctaagaagtctgtttttgactagcgaccaaaatagttgctcatcaatactaatttagtggttagtcccatgtacatcctagtgtagaacggggtgtgactgtggctcaccgaggtccgtgacctgctggctaaaggtccccatcatcttgagcacttgatcaatctgtggtgcgcccaactggttgacccagtgatcaaagtgctgggtaatggcttggtcgacaatccgttcgacttgttgtccccgttctgttaaatgtaagtagagccgccgccgatcacgcggatctggcacctgaaaaacatagtgttgcattaacaatgatttgacttgccgtgaaatcgcgcttcgcgttacttgtcgctgaattgcaatatcattgagtgtcacttcatcagtcgtggcaatgcgccgcaatattaaaaattgttcaaatgacagtttattttgacttaaaggccaagccactaagtccatcataattttggttgtattttgatatgcttcaaaataatcattgagaagtttgcttaattcgtcactgttcatcgcgatcaccatcacttcattaacttttgaccaaatataacacgcctttaactgttttgcatgaaattacccgtaaattccaacgttaagcatcctccctaacaattttgtgcaacaaagtgtatgatgaaagtagttgaaacgcttacgtaaaaaggagacgagaccatgcccctgacacccttacatcaagttgaattgcgcttgatgcgtaccgtcatcgcaatctgtgaggctgaaaatatcgattactttttgatcggtggttctttactcggtgctattcgtcatcacggatttattccgtgggacgatgacatcgacattggaatgcgccgtcatgactaccagcgctttatcgccgtcgccaaccaccatcttgatccaaacaaatttttcctacaaaccggtgcctcagatccggactatgcactcagttatatgaagctattagacgtaaatacttacattgaagaacgcaacaacgtcaataatgcgtttaaaggcgtgttcgttgacatctttccgtttgataagattccagatgacgaagccttacgtcgttcacagatgttacattacaaattagcagacgctgcgatcctgctcaaattgaattaccgctttgtcaaaacaccactgcgtaacttgattacgaaacacacacctcagcaattagctgaagtcaatcgctataagctggaacgtgaggaatacatgcgcctgtacgagcagtcagactcccgaacttacaaaaatctggcgtctcaatacgattacgaaaaggaaattatgacctatcaggaattgaccgagctaacgaccgttccattcgaagatatccaagtgaagattcccagtgcgtatgacaccattttgacccggatgtatggtgattacatgcagctgccaccagctgataaacgagttgaaaaacatctgaacaaactaattatcgataatcacgaaatcttataatatcaactagcgtggttcaggcatactcgttacggctgagccacgcctttttggtatcttggatcaaacgtgccaagttaggttagcgttcgctaccgctgaaaccggggtaatcatcacatcaaccacctaactagtaagattcatacaaagttaatgatggccttaattacgcttaactttcgtataaaaactaaaagtaatcgctaactgtttcactactaaaatactaatttaactaaccccaacctgtgttaaacttaaattaaatacatgactttaaccttattgggggtcaggaaatcataaaaatgggggatcgccatggcagcaaaattatttggaattatgatgattaacgttcagagtattgaattgtcgattgtcaatttacgcacattacgccaagtagaacgagttcgttccgacgtttcacttggtgaggatatttatgatcagcatacgatcgattatgattcagtggaacaagccgcacaggcactgagtggttttgttcagatcatgaacgattacggcgttaaggactaccatttatgggggtcgtggtccttgtcatccgctaacaatgccgactatattcaagaccaattacttgtccggactgggctcaagatcgactggttatctagtagtcaggaaacctacctgcgttcagtcgcagttgcggtacactttccacgattcaagcaaatgatcacgaagccgacctacttattaggaatcaactctggtagtgtcggtatttcgcactacgatcagagtaactttgtcttctcccgtagtctccgtttaggaccagttcgaatcgcggaagttcttgaagacttgcaatcgagcgtgcctaactatgtcgaagttttggatgattatatttcgagtcaaatcgttgactttggccgcttcttgcccgggcgaagagatcaacctagtaacgtcgtcatgctcggcgtcgcgccgtttgccaccctctttcgccaacaacaatcaaaagctggcgtggaggaactcagcaaagcagattttcaagctttatatgaggacgtgttgaacgcctctgaccagtatttaatggataaatacgaagttgatgaagaagacgtgcgcctaatcgtgcccgaattactacttattaacgagttactacaactcactaatgctgagaaaatctggcttggcaacgtgaccgtgctggatgggttaattattcaagaagccattaagttgggctataagaaatataactttaatgatcaaatcgtaacagcagctaagaacattgcggaccggtacaacgttgaacccaaacatcgcgatttggttaccaaattctcattgcacctattcgaccagctcaaaccgctacaccacttaggtaaacgggagcggctactcttacaagtagcggctatcgtgcacgacgttgggagttatatcgatccacaccaacattacttacattcggactatatcttgcaggccactgaactcatgggattaaccgataccgaaaaacgaatggtcgccctgatttcacgctaccatagcgcgcaaacaccatcaaaagacattcgccattttggacacttacaagtcgaacaacgcttattagtctccaaactatccgccatcttgagaattgcggacgctttggatgacggtcgcaaacaaaaaattgataaaatttccgtttcaattcgcaatccacgggtcatcattacttgctttgctcatgatgacctcttcttagaaaattgggtattcgcacaaaaagcggaattctttaaagaagtctttggtttaacaccagtgattaaactacggggggtacgttaaatgaattattataaagaaagttattatacaaaccgtgaactcagctggcttgattttaactatcgtgtccttgatgaagcacgtgataaggataaccccttgctagaacgtgtccgttttctcgggatcacacagagtaatcttgacgaattcttcacggtccgggtcgcatcattacgtaaattgatgtcagtcaattacactaaaccggatcccgcgggactgaccgctgctgatcaagtcagtgcaatcagtgataaagcccacgagatggtcaagcgtcaatacaatacattaaaccgctcgcttttgccattgctggaacagcacgcgattcatctcttgtcgatggctgatctaaacgaggaacaacacgcctttgttaagaactactttgatgatgagctgtacccggctttaacaccgatggcagacgactcttcacgcccattcccgttcattgggaataatacactcaacatcgccttacggatttataaaaatggggataagaaggaccgcaagtttgccaccgttcaagtgccggacgtctttcctcgcgtggtcgttttgccaggcgcaccgaaccagtttattctgattgaggaaattatcaaagcctttgtcggctcactatttatcaactacacggtcaaggaaacgagctgttaccgcgtcatgcgggatttggacttagatgtcgccgaagaggatacctcggacttattaaaggaagttcaaaaacaattaaagatgcgtgaacgcggtaaggtcatgcgcttagaagtcgaaaagagtatgagcaaacatcaacgtacgcgactcgctaaagcccttgggattaacgaaagtgcgttatacgtcatcaacggtcccctcaacttgaccttcttatccaagctggtgaaagctgtgcagggccacgaagacttgaattatccaaaataccacgcctactatcccgcgaagtaccgcgaacgatccatctttgatcttatcaaggatcacgacattttaatgcaatatccgtacgatgatttcaaacccgttgtggactttatccatgaagctgcagaagatgaggacgtgttagccattaagatgacgctgtatcgcgtatcagctgattcaccgattatcaagtatctcgggcaggctgcccaaaacggcaaacaagtaaccgttctcgttgaagttaaggcccgttttgatgaagaaaataacgttcactgggcgaaaaagcttgaagaaatgggttgtcacgtgatctacggtctgatcgggcttaagacacactgtaagcttgccctcgttgttcggcgagaaaacgaaggtatcaagcgctacatgcacatgggaactgggaattataacgatgtcaccgcccatttctacacggacatggggctcttcaccgctgatacagacatgggaatcgatgcttccaacatctttaacatgttatctggctattctgaaccaccgtatttccacaaattgcacatctcaccagatggcatccgcgactttatcaacgaaaagctagacgatgagattgccattgccaaagctggtcagcccgcagttgtcaaaatgaagatgaactcattatccgatccgcagattattagtaaactctacgaagcttctcacgccggtgttaagatccaactgatcattcggggaatttgttgtttacgaacaggcatcaaaggtatctcggataacatcgaggtccactcgatcattggtcgccttctggagcacagtcgtatatactactttagcaacgacggtgaaccacaaatttacttatccagtgcggatatgatgacccgtaacctaaatcgccgggtcgaattattgttcccactactccaacctgaaatcagtcaccgtgcgatgacaatttttgaaacaatgtgggctgacacggtcaaaacgcgcattttgcaaccagataatacgtacgcccgtgtggatgggcgcggcttagaggttttggactcccaggccgaattcattcgcgaagccgagcaagcagtcaaggctgatcacggcgatactacgcccactagcaacgcgcaccagttcattccgatgatgagtcccaagaatgagccggatgcttcagatcttgatagagaggatgattagcgatggaaaactttgcggtcattgacttaggttccaattcatgtcgaatgacaattacacagattcaggaagacggtagttatgcggtcactcaccgactcaaggaaatggtgcgtttatccgagaatgaaaacgccacggatacgccgacccttcaagccgaggccattgaccgcacgattgcagcgctaaagtcatttgctgccgtctacaaagacttacctaacttaactatcaaggccgtggcgaccgccgcaacgcgaaaggccagcaaccaaaagaaatttctcaaacgcgttaaaaatgatgttggcctagatatcgaagtgattcctggaacaaccgaggcctattacgattacttaggggtagtcaatacgcttccaacgactaactgcgtcatggtcgatactggtggcggtagctgcgaactcgtccttatcgtaaacggccaagccaaggacctaatcagtctgccaatcggcgcggtcagtttatccgaaaagttcggcctcaacgaccaagttaccgctagtcaattatttaaaacgatgactttcgttgataaaatttttaatagcgtctggtggttgcgaaacggtctcaacttaccactcgtctgtttgggtggtagcaaccgaacgttagccaaaattaaccggcgcaaatgcaatatcctcaactttgaagatattcacggttatcggctacgtgacaacgccatctatgacacattcaatactgtcattagccaggatgcagctggtcgcgcggctattcctggattagcaaaggaccgggctgatattattgttggtgggatgattcctgccattagtctgatgcgctttttagattctgaccggatgattttctctcaaaatggactgcgtgaaggcatcctattcgagcacctgactgctttagctgaacaaagcgctaaagtcagcgaataaaaaaatcggactgacatttttatcagtagtatgctaggattaaaacattaataaattcatcaaggtcgtctttgatgcttgtatatctttacaacggaatctccgttggtcaagaaaagcgtcgtttcacatacgaaacgagctggccttgatcaatggaggttttattttgtctacaacaacacctgtcatcccaacccaaacgaaggttgcaatttttggcaccgccagtctggctttttgcggtattttagttgaaacatcaatgaacgttacctttccgaccttgatgcaccaattccacaccactctagcaacggttcaatgggtcaccactgcctatttactcgccgtagccgctaccatggttattacggcgtttattcaacaacgcttccgttggcggacaattattaacgttggcggggctggtttcgttcttggcggtttattatgtacagtcgcgccacagctctggttactactattcggtcgaatcattcaagccatcggaactggattggcattaccattagtatttgcgcaaatcatgaccctggtccctttcactgctcagggtcgttttacggggaccgctggaatgttgatcgcattggccccttcactcggaccaacatatggcggcttagtgacacaactattatcctggcgcttaattttcggcattaccctaccgtttggtctgattgcttggctgataacggccaaaactattcgccaaacgcaggcaccacggtcacgtccgttccccttatgccaattcgggctagtcgtcgcggcactcatcctgctgatttttagcgtcaataaccttagtacacatggcttaagcttagtattcgtctggttaccactgttattagcggtactcgccgtactgacttttacccgttcggcaacccgaaccacgcacccactaatcaacctggccgtcttccaacagggtgactttacccgggcgcttctcatttacttcttcattcaattcattcagattggactgacctttctgctccctaattttgcacaactcgctttgggtaaaaatgcgttagtgtcgggcttaatgctattagcaggaagcttatgttcagcaatactatcacctttggctggtaaattgatggaccgtcgcggcattcggcgaccattccaaattggtagtggctttttactgttggcaacactaagtctcgcagggttagcccagcatctctcggtcggcttgatcattggcttatttgttggctttcaaattgggttcagttgcttatttaacaatgccctgacgtatggtttacaacaattgccgccccaactaatgggcgatggcaacgcgcttttcaacaccctacaacagtattctggttcgctcggtaccgccattatggccgtcttgattacattgggcacccgcatggcaccgagtgcttcgagtacgatgcaaaccaccctcggcacccagatcgcactctggttcagtctaattatcattatgattgtagctgctttagcgctgactacgaaaccaattgcgaatatggctgacgaccaacatcaatcacggtcatctaaccactgatttacttgggatttggttaagccgttaaaggcttcattaagcttcacgtcttctttacttctgaccactgagtttacggtaagatacagttaatccaaaccgaggagtggtgtgcatgcgttgggaaccgttcagaattattttaatagttgcaacactaagttgtttggtgattcttgtccacgtttgccagccacaagcccggacgcggcagctactcggcttaggttacttatttggccttagtgtgattttgtttaccccgctgtcattcgacggaactgccatctacgtgatgccagctggtgtcggccaagtgaacctatcacggttgtatcttcacgggctgggctttatcgaaaatatcattctgacgattcccttaggctggggaattaaacgccactttcatcactacccactattgggcctcggattaacgggcttgttagtgggtgccagcattgaaagtctgcaatatttcatgtcacaacattggctgatcaatcgcagtagcgatatcaacgacgtcattgccaacgcaacgggtatcctgattggcggactcgtggcagctaccttccaatttgtggcccagcaccgtaagacaagcgtcacggattactgatcacaactgtatcctgaagcttgcacccccttgctggctgcttaatgctcgactgcgccgtaaatcacggcatggcgctcaacttaaattcacaaacgcagtgacaaaaagacggttgttagaccaataatagtctaacaaccgtcttttgtggcgtcttctcaattttaatggttagttgtggacttgtcctcatgcgcggcacgttgcgcttgctgatcttgatgccagctagttggactccataattggccttccattgaaccccgtagactctcaatctcagcctgttggtcatcgatgaccttaatgatactctccacaacaacttgattatcagccgtcttcaaagcggcgagtgcctggatcgcccaggcagcctggtcttgttcactcattatgttaaaatctccgtttcctttaagcctttttacattgtacacaaaccaactgattataccaaggaatctgcttactcagcaaaggtaacgggcggtaatcggcaagtaaaataacgccctacactgcgatacgctgttaagaagacacgcaacctaacgcgccctggtggctggctgatattgttctttcgacaaaaaaacgccccatcaagaatatcaacacaattcttgatgggccgctttcgtctcaaacgctaaatccgattaaccaactgcttgttgatcatcgtcataaagtttttgttgaatttcacgtaattcagacttacgtaccgaacgtggcaaaaatgcccgaatgtcctcttcgttataaccgatttgtaaccgccgaccatcataaatgattggccgcttgagtaattgtggtttttcaactaataggtccaataactgattgaagcctaagtccgacaaatcaatgtgtaatgctttgaaagccttagaacgcgttgaaacgatgtcctcgaagccattttcagtgagccggaggatttgtttcaattcatcgcgatccagaggattagcaataatgtcgcgttcattaaatggaatgttattctcaactaaccatgctcgtgcactacgactagacttgctggacgttgaataatataagtttactgtcacgatgaattcctcctaagtttcagcaagtgactttacaccacttactttaatatagtaagtatacggttttagtcaagaatagtcaaggtttgtcagaacttttttagttaattatttctaaagttctgccagccaattacccatcaaatgccagcgctattctgtacttgtgccgacaaaagcggtacctcacgagataccgctacttaactaaacatgaccaactgcccgggctgggatcgaaccagcgacctcttgattaacagtcaattattctaccgctgaactaccgggcaatgattatgtctgtatttatacacgcttttatgataaaaaacaagtcctttttaaaaaaagtcacactaaattcacataattaatatgatatccacctcaaacaacgtacaaacctaaccacgataccacggaaaagtcctgtttcgaaaagcgttgtgccagtgtattagtgatttctaattcactcaatgtcgtttttaactcaaagtagtaatccccacgctgattatgcagtgccagttgccagctacctaaatcatcccagcaagtcgtatcgggagcggcctgttgatgcttaaacaacacgtgaaaagtcggcttccacgtctcgtgatcgtctcctgtaatacagatcaagcgacacacttcccggtgacaacgaatcgctgtccgaacaccaacgataatacctgccaccatcacccccgcaccaagtgccaacccaagtaataacaaccgggttaatagtggcgttgcttgcaattgcgagctaatcacaatcgtcgcactcatcatgagccagactaccaatacccagccattgagccagttcaaggcgacatcgcgagcatgtcgatacactgctaagcggtattgttgatcattattgaccactcgttgtttaggggccacagttgaataaaccaccgccatatcatcatgaaacgtataactagtaagtggttggaagaccgtcgtcatagcttgtaacgtcgtctgtggcatgtattcggcaatcagctgacgtgcttgtgggacttctttaaactgataactcagaccgtgaatcgccgtcaattgatagccccacgccgcctgccgattgagccaagcaacctcggcagcagagcctttaagaaaaaagcgtcgtttttgcatactaggaatcctccatttcacaccgatttgagtccccattatatgccgattggtctacatttcaaatattcattaatcttagttcaacaccgttactaaccgttgtacaaaagtaatattatcaaaacaagcatggtaaccctttcttcattccagcggattggtatgggtgtgatgattaattctagatacttcgtgggacgccagtttatatattaagtttttgatatttattcacaaatccactcatccatgctagcatcaaagatgatgttattgattacaatcttcggaggaacaagttatgtcagccaaatatatcatggccattgacgaggggaccacgagtacccgcaccattatttttaatcacgccggtcaaaaagttgccgacgcccaaaaggagtttccacaatactttccgcaaccggggtgggtcgaacacgacgctactgaaatctggaacgcggtttcctcaacgatcgctaacgtcttaattgacgctaatattaaacctaatcaaatcgaagccatcgggatcaccaatcaacgtgagactaccgttgtctgggacaagcaaaccggtctacccatttataacgccattgtttggcagtcccggcaaactgcaccgttagctgagcaactcatcgctgatggtatgggcgatctgattcaccggcacaccggcctagtgaccgacgcctacttctcagcaacgaaaattcgctggatcttagaccacgttgatggtgcccaaaagcgcgcggaacgcggcgaacttcttttcgggactattgatacttggctcgtctggaaattgactggtggcgagacccacgtcaccgactacaccaacgccagtcgcaccatgttattcaacattcacgacttacaatgggaccaaacgattctgaacctactgaacattcctgctgcgatgctcccagaagtacggtccaactctgagatctatggcacgactaaggactacttgctttatggtagccaaattccaatcagcgggatggccggcgaccaacaagccgcactatttggtcagatggcctttgaacctggcatggtcaaaaatacttatggaaccggtgcctttaccgtcatgaatctgggcgagcaaccgcaattatccgaccacaaccttttaacgaccatcgcttacgggcttgatggcaacatcaattacgcgcttgaaggctccatcttcgtagcgggttcggccctgcaatggttacgcgatggcatgcaactgatcgaatcagcaccagaatccgaaagtcttgctcaacagtcccataatcacaacgaagtttacgtagttcccgcctttaccggattgggcgcaccttactgggattccgagacccgtggagccgtctttggcttaacccgcgggaccacccgggctgattttgttaaagccacactacagtcactggcctaccagtcccgcgacgtcattgatacgatgaaaaacgacgccaacatcaccatgcccacactcatggtcgacggcggggcagcccgcaacaactggctgatgcaatttcaagccgacatctcaaatgtcaagatcatccgggccgctgacctcgaaacgaccgcactcggtgctgcattcttagccggcctagccgtgggatactggcaagatttggacgaactcaaatcaatccaccaaaccggcaatgtcttccaaccccgaatggccgcgccccaacgtgcgaacctttaccaaggctggcaagccgccgtcaaagcagcccaactattcaagcacaccccaatcgacgcccaatcaagtaccaactaaactaaatttctagtcaaaaacgccgcgactgaagtcagtcgcgacgtttttagttcagcactattttccttgaatccatcactgccattctcatctatccgataatccgcactgtgtttgttgcttttcatgattaaaacgtgccgattaggtggatttctgttcgtcagcaatgatcgtcctattccgacctccggggctgggtgacaattgctggaacgtaagccgacgtcgatttgagcccgtgcacaacccgcccggtctcaaatacgagtcttattctaagccggaagcagaccacttccgactaagaataatttggctactgagcattgtcacccagcccctccagtctcaagcttgcgaggggccacgggttgaagccgagcattgcctgccaacggattaatgcggttttggcattagtccattggcgtagcaagcacaggctttagtggcaccgaacacgtttcgggaagccgctcgaatggctgatgaacgaccacttaactcggcacaattggtcgttgactattttgatacaggaactttaaacgagacgttagggttaccctaaccactttgttgaaacgttcgattactactatggtgattccgaaatagtaagctatcacaatgtcattttctgcctgacagttgctcgacaaaattactgtttatgaagaacaatgatgagtccaataaaagttgggtacatctccgtctgccattcgaacactgtcccgactggaaggcgtttctgacaatgcccagtggtgaaatttcacttagcaagcgtcttgtgcttggttagtgaaaggccagtatttaagacgtgggcttcggcttaaatctgtgcccaccacgttccggcaattggcagaaatgcctggaagtcggcataggacacactaactaagcaagtttacgctaacctgaactttttccagcgggtctaagctggttgcttttgaacttaaaaacttggcacgttttaatcatgattgatgacagattaatgaatatcgcgtggggtttatgataattgtagttcgtctacttttttgaaggcgtgactggctagaaatagcaggaatatgccggcataaaagagggcaaatagtaataagaatagccgtaaatcaaagcggtcagctaggaaagaaaacgctagcgaacccagcggtaaggtcacggaaaccagcgtataaaagcaggtcattaccttcccgagttggtctgaaccgaccgtcgcttgaatcatcggtgtctcaaatacttgcgtcagtccttgaaagacaaagctcagtaagtaaatgatggcaaacagccagaactggttgtacgacactactgtcaagatcatgaataacgcgcgcccaaagttgccgatgaggtaagactgccgaacggtcaacttttttaactgtcagtagactaccgtcatccctaataatattccaacggctgacatcgactccaaaataccgtagtagatcgagtcaccgaaatgccgcccaaataaaacgacgtacgtattcaaaccgccaaagaagaaattcatgacgacgctcgcaaacgtcaataaacgcagcagcggatcagtgctgataattttgaaaccaaccaaaatctggttgagatacaaggacttttcccgcgtgtgttgctgacggggttcagcgagtttgatccgcctaaaagtggcaacggtaacgacaaacgtggctgcatccatgattaaaacaccgagcactgagcagaagctgatcaaaaatccagacagcgcgttgaacacgtaatccgttcccttgtaggcaattgacatgtccgcttgtgcttgaactagctggtctggctcaacgagcagcggtactaatgtatcttgaatcggataagctagtgatccaaaaagggccgcgacgaataccagcccgacatagatacctggcaacttaatatgtaacgcaactaatccaattagcatgaccacgatcactaactgtgaaaattcaaccgcgactaataatcggcgtttagaatgtcggtcgatactgtcaccaaacagaaacaacaacacgcccggtaaaacaatagccacattcatgatgccgatccacaacgcactgttggtcaattggagaatgaaccagttcatggcaatcatgtagatgctgtcaccagcgttacccactgctcgccctaagacgagttttctgaagttggcattgatcacattatccgcccctttcaagccttgcaacaatgttactatcacacatcagaataaggatcgactcagctttcactcgaatctgcaacgcagcccgggcctgcttagtaaacatcgtctcagaattaattatattataattagtaaaaataacaatatttaatcttattttaatgttaagattcgtcctcccaggtaccaaaaaatctcccatgtcagctaatagcgacatgggagcgttacattaacggttatttttcgttcagccattctaattattagtgttatggtaacgattattggtctaattccggcaaaaagccctgctgcctagcgattgtcaaaaactctcgccgtttggccgctgagtgggtcgcttcctgcgtcatgtgcgctaagtgttccgtacgggcgtgactactccgatgttgataatactgattcaaaacgccatcaaaccggtccaactccgcctgataactcgcaggctcagcataggtatcttgaaacaacacagcgggcaaccctaatcgaggtttcttttcaggaacatccgctgggtgccctaactgcaacccaaagacgggtaacgtcaagtccggcaagtgtagtgcgtcaatcaccgcctgcgtgtcgttgttaattgatccaagtacaacgctaccaagacccatgctttcagcgaccatcaccatcgccgctgtaatcagcgtggcatcttcaatactaccagcaaagcggtcaaattcactcagtgcccgacgcgtcgttgcgcccggtgctagcttgacgttgcggtgttggtccgcaaccacaactaataaacggccgttttcaccaaccgttggcatcatcgtaatcgtggccaattgttgccgtagtgcaggctgagtgatctcaatcaaactgtatgcctgtaaatattggctagtcggcatttgttgtgccgttgtgatgatttgcgcgaattgcgcatcactaattggttcagtggtaaattgtcgccgcgttcgatggtcctgtaaggtttcaatcacactctttgtcacttaaaatcgctcctgttcttgttgtaattcccgtgaccagtccgttaattgtggcaacacgtccaggttcaagttaaacacaattcgttgacacacttgatcaagctgtacgctccgaaataagggataacgggtcctgccctgatcctggtgtatgataacacttaacgtaaccagctcatctaacgccgtttctaacagtgtcatcgcacgctgcggaaaatattctcgctgtagtgccggcgcgtccaatgagcagcctgccaacgcttcaacatctcgccgagtcaataacagactttccggatgttcgccaatcaatcgacttaaaatctgaacagtcaattgggtctcaaacgcgttacgaaaacgaaaacgggtctggaaatgactttgaataaattgtagcaatgccccattcttcatttaataacgagcctccttaaacatgcttattgataataacactgatactagcgtttgtaagttattttcccccactacgcacccgcaattaaatcaccacaatcagtcaatttcatgatccaaacaaaaaagctgagcttagagaattgacattctgaaagttcaacttttgagccaacgcctactaaaaaaacaaccgccgtttgataaactcacactcctgcgctagactttggctaacagcttttagccaatatgattttctttcaaaatcagatcgacctcagcttgcatgtcaggtgtttttgtccattcttcccaatgatccatcgtttcatcgggaatcgtaaatgtttcattaatatattgctcatacttggcaacatgcgtggaatgcggaatgtttagttgtaatatccgcacttgcttaataaaaccacgttcagctgctaactcagcgcggccattcatcaacatgtttccgatctccatgtatgaggtcccatcattacgtgttatttcttgaattaagtctaatacttcatggtttttcaactgcaatccctcacttcacattttagtataagcggggttggcagtcgtgtcaaaactgaccagtaattgccaggtgatcaggcttggtatgcctaatcacctgtacttgatgaacactaaactagctcagtcagccccaaaatgctaccatcagccgagcactcctttttctgagtaaacatcaatcttcaaaaattacaagagagccttatcttcatctggtccgccatcgattcgctaatttcactcaaaaaaccactatccaagcagatagtggtcggcataagagagaaagagaattgattagaaggtaattaaataccttacaaactaagaataagcgatattgtaagcgttgtcaacagttagtcaaaataaatagataaattatttctatttactcactaatctttttctaacaccctcagccagccatgttcgccactaaattgccgtctttacttgcacaaagttaattaattcaccttatttaatagattggtaccattcacaattaccaagatttaaaacaaacttctcaacctagataattttaattattatcaacaatcaattataattatttacactggttatttaaattgacttcactagcaactaaccctgtcactctcgcattaacacttgctgggttattattcgcattccctttaagaatgaaatatactaaaagtaggcggtaacatgtcaggcagctatgggagtgagggcattatgaaaataatcgagcatcaggggaacgggattaattattatacattagtgaacaatcatcatatgagcgtcactattatggactggggcgccacagtcaccgcgatcaaaacccatgataaagatggtaattttgcaaatattgtcttgggatttgacgacggcgccgactacatcacctatcaatcttttttcggtgcaaccatcgctcgggttgcggggatcatcaaaaatgcccggtggcggcagtatgacttaactcaaaatgcgggcgaaaatcatctaaacggtggtaatatgcctcaaatttcatttgaaccatggtttttagaacgtaaactgcacactagtgatcaagttggactcgtcatgcaatatattaccttggacggtgagaacggctatcccgggacaatgacgatcacggctaatttcgtattagataacgacggtaaatttactattagctacactggtaaaagtgataaaacaaccttattcaaccccagcaaccatacctacttcaatctaagtggggatgcggaacgcctcattgaccaccatgttcttaaaatcaatgcagacgagtacgccgcgttaaacaaacacggtattccaactggtaagttgccatgggtcaccgacaccccatttgattttcgtgacccagtcgaggttgggccccaggttgctaacatcaagggcgggctccatcacggcttcgtcttaaacgacaccccatatccacaagtagaattactagatcgcatcagtggacgcaaagtcacgatgcgaacgaacgctccggcagtcgtggtttccagtgcaactaattaccgtgatgatcgttatcgactcaatggcggtaaaccgatgcgttctcaacttggtctttccctgcaagcacaaaaattaccggatgctattcaccacaaggaatttggcagtatcattatcgaacctaatattcctgtaacctaccaaacggcctatcgtttttctaatatttacgacgtctaaccactcaagaatgattcaaattgacctcccagaatgcaaactactgggagcttttttgactcactaataatgcgttacaccataccattgactgaacgaaaatctcctaacccattttagtcgacggacatggcctcattaccatttacctactaggcgcatatgctattatgcacgttgcgcgagttaatctgtcatgactcaggacgagttaactatcaaaataagtgctattatgataataatacccacatgtggcttaacgactagtacatttagcggcggtttaataatgaccaccccatcaaatgtaattaataaggaggatcagattatgccagctactgacttacgtgttcagcgcacccagactgcgctgaaagaggcttttcggacgcttgctttaaagtatccgcgctatcgtgatattactgttaaggagctcacaagtgtcgctaatatcaaccgcaaaactttctatttacatttcgattccattgacgatttagcggaaacgttcgttcaagaaggtgctgataagattctagcactcattgacccgcaagatttcaagaaaaacattagccaacccggcttaatctttgatcgcttagtgacctattttcgccaatctgaagcttttcaccgagtcattttgttgaatgatgattacagttttttgtctcggaaaatccacgctgccgtggtagcagggcttacaacgacgattcaaacaaactatcatttatctgcaatcgatgctaaggtctgttcaagctttttgatccacaacaatttaacctttttccggctctattttaatggtgatttaggactatctttggctgaactaaagcagcgtttagtttcgctcaacacttatggcattcatcaattcttctaccctaatcaatcactttaataggacccaaaaagctgagctatcgaataacgatgttcattcgatagctcagctttttactgactagttataggcttttaattatttaacaactcttgttcaatggttgctaataccccatcatgttcattatccagggccgtcacgtgttttgctgcggcttgaatgtccgccggtgcgttgcacatcgcataactgtgcgctgcatatcgcaataatgggacatcattcgccccatcaccgaaggccatcacattagctgcagttaacccaagtttagtcgccaagaattgaattgctggtaattttccgacccgctgatcaaccaaatctacgacgccatacccactatcatgcgcacgtaactcgccatcaaaataatcattagctcgtgccaccagatcagcagcctggtccggtgacgttgagatactgatttttttaacggtatcatcaacagtggccagatccgcaaccaagtgtaaatgatcataaaactgacgggccatcgctactaacttatcaggtgctcctaactcagtatacgacccatggctaccaactaagattacgtatgcgtctttgaatagtggctggtaacgatcaacagtcacaaactttcgttgctggtctgctgaaagactaccatcaaagatcaagcggtcctgggcataaatcgacgccccattttcagcaacaacgataagattatccgccataacatctttaaataactgtctaagatgggcatattggttaccggacgaaagtactagggaaacatttatcgcccgtaactgcgccaatacccgtttaaaccgttctttgtcgaaacgctgatcttgatgcaataatgttccattcaagtcagttgcaattaaattgattgccacaagtagccaccccatcttttatcatttactaacaaaatcggcctcgtctcgtcatgtgattcagccgattaaacatcaacatggcactcagttacattgctacgaatactattgtagcataccattattgtcatgccataaatgtcgcgggtagttgcggtttggcaaaataatatccttgccctcgcgtaatgcctagatgattagccagttgaacatcagccgctgattcaatgccttcaaaggtaaatagcatttgctgttcctccgccttatcaaaccaaaatttgagcgtcgaaacaattgcatccgtagttggggtccccagcggtcgcatattttgtaacgcgaatttaaccgtattcacatatggcaacatcattttgatctgttggaataggttatcagaaccaacatcatcaaaagcaagtaatataccagctgcccggtacccaacacttaattgctgtaactcacttagctcaggtgtcgcaactagctcaacagttagttctcgtggtaacaaatgcgtctgcacatagtgactaattgcagcttgaaagtcaggattagcaaactgacgcgccgttaaattgatggaaacatgatggttatttaattcctgaatagcgcaatccagcaattgaatcaattctgttggcgctatttcaaaggtcgctggtattcgccaagtttgttgcctctcatcccactgtcgtaataataactcatacaagattgttcggttggttccaaggttattaattggctgtgcaaaatatttatatttcagcatgaccattcatccccaatagtctaattatttagttgtgttatcgcaaccgcttactttatcataccaaaagatcgtcaactttcacaatagtcttatgaatattagtagttaaaaattatgcaaaagctttgtgggcaatcaaaaaacgccaccgtaatcgaacggtgacgtttcttggtgcccacacacttactttaaattattcaacggtcacactcttggcaaggttccgtggtttgtccacatctaagcccttgtttaagctcgtgtagtaggccaataactgaccaggaacaacactaagcaaagccgttaatcgttcatcaaccgttggcaagataaccgtgtcaccatctttagctaaactatcggtgacgatagtaactgtcttagctccccgtgcagcaacttcttgtaagttggagcgggtcaacccagcggtattcttttgcgtaataatcccaatcactggggtatccttttcaatcaaagcaatcgtaccgtgctttaattcaccagatgcgaaaccttcagcttgaacgtaagagatttccttgagtttcaaggccgtttctaatgagacggcgtaatccagtccccgaccaatataaaaggcgtttggcgtattcaataaggcactcttagcaatcttttcaaaagtagccttttcatcaactaagctttgcatcccattagcgactaacgccaactgctgtttcacgtcgaaagctgttgcagctggttggtcaacggccacacctaacgctttagccaagatggcttgtaaggcaatctgtgcggtataggctttggttgaagcaaccgcaatttctgggccggcatgcaataacaacgtgtacgttgcttcgcgtgataacgttgagtttggcacgttcgtgatggtcaagcttgggaaatgttgatcgttcacattcaataacacttcacgactatcagcagtttcaccagactgggtcaagaagatgaagaatggatgtgctgataataatggttggttgtatgcaaattctgacgaaacgtgcacttcagttggcacgttagccaacgattcaaataactttgcaccaaccagaccagcatgataactagtcccagcagccacaatgtatagtcgatcggctgctttaagagctgttaacaagtcatcattgatgattggatcacccgcatcattaagataaacttgggatagcttccgcatcacattcggttgttcatcgatttcttttaacatgtagaatggataagttcccttgtcagcttgagctgcgtcaatgtcgacatggaatggcttccgttcaactggttcaccggcctggttcgtgattttaatttcatcaggtttaacgaccacgatttcgccatcatgtaattccaagaaatctttcgtttggtctaacatcgctaaactatctgagcagaccacgttgaagccttcgccgaccccaattaataatggactcttattctttgcgacgtataaggtgtcaggatcttccttatccatcagtaagaacccatatgaagaatggccgagtagccctaacgtcttacggaaagcggccaacgtactcaagccttccttggtgacaaaccgatcgactaattgaacaatgacttctgtatctgtttgagacttaaaagtcacgtcacttaaataagtctgttttaagtcttcaaagttttcgatcacgccattgtgaactaagtagaagcggccatccgcagaaacttgaggatgcgcattggcaacactcggttcaccgtgagtcgcccagcgagtatgcccaatcccggtcgaaccatgaacagcttcgcctatttctttacgtaagtcatcgatccgacccttttccttaactaaatagtcatgaccatcttgatcattgacatagataccagctgaatcatagcctcggtattccaacttttccaatccgttcaataagattgatactgcactatctttacccgttacaccaacaattccacacataaattaatcttcctttactgtttgaattgtttctagctgcgtggtcaatatatctgtcaccaacctcacagtcggtttttgtaattgacctgtagagtgcagtccctgacgtcacccgtcgattatcgataaacgtcatcctcgtcaactttagattctaaagtcctggcgctattccgctttaaccaattaacaattggtctagtctaacctccaattggtatatttcctagaaacaagttaactttaccgttacatctaataaaagtcaacaatgtattatattggtatacgtgttagttagcgtgtataccaatctcaaacgcttataaatcaagggcatcacgaattttcgaattttttgtaacttttttgcggtcaaattggtttgggaggcactgggtcccctgacagtcgccagttaaccgcatttagcaataaccgttcgtttcatggcaacaaaaaagtcgcaactctaagagtaacgactttttttgatgatcggtctgatcacttaattattcaacgccaacttcagctttgaccacatcgacgatccgatctacataagcgctaaccagttcgtcggtcttcgcttctgccatgacccgcaataaatcttgggttccagaaggccgtaccaagacgcgaccatcaccggccatttcatcttcaacgtccttgataactgccttgatcttatcattgttcaaagcggctttcttgtcttgaaccttaacattcactaacttttgtgggtaagtcgtcacttcggcggctaattcagaaagcttcttacccgtttccttcatgacgtgcaataactgaattccagtcaacatgccatcacccgtcgtattaaagtctaagaagaccacgtgaccagattgttcaccaccaaggttatagccgtccttcaacatctcttcgacaacgtagcggtcaccaacttgggtctgcttgctgtgcaaaccagctgcttctaaggccttgtataagcccaggttactcatgaccgttgtgacgaccgtatcctgcttcaacttgcctcgttcactgaggaattttccacagatgtacataatcttgtcaccgtcaataatgtttccaagttcatcgactgcgatacaacggtcaccgtctccatcaaaggctaaaccaacttgagcgcctttttcaacgacgaatttagataatgcttcgggatgcgttgagccgacccctttgttgatgttcaagccatctggtgccgtagccatcgtatcaaattccacgttcaaatccgcaaaaatccgggaaactaagttactggtagaaccattggcaccatcgacagccaaatgaatgccacttaagtcatctggaatcgtttgttccaagaattgtgaatatttaagattaccctctggaaaatcagcaactgtccccagaccttctgctgctggccgtggtaaagtgtctttcggttgatccagtaattcttcgatttcttcttccttggcatcagacaacttgaagccgtcgccaccgaagaacttgatcccgttatcttcaactggattgtgagaagccgagatcatgacacccgcgtcagcatcttggatccgtactaagtaggccactcctggcgtcgtaattacaccgagacgtaaaacttcaattccggctgaaagcaagccggcaatcaaggcttcttccagcatttggcccgaaatccgggtatcgcgtgcaactaaaacgcgtggttgcgtactcttgttttccgcatgttccgtcaatacgtagccaccagcacgacctaaacgaaaagccatttcaggtgttaagcctgaatttgcaattccccgaacaccatcagtaccaaaatatttcattataatttacctcatttcaaaagtgtcatgattaatcatttttaactgtaatttttactttgaccgacgttgggctaactgacgagatcccatcctcatcgctagtcgaaacatcgaccgtcttagtcgtggttgaatcaacattcgtcacatcaacattgactggcaaagacttcaacttcgccaatgccgccttcgtgccagtaaccgtcactgacttcgtgtcagatgagaatgaataactggtgtccgccgcggtcttgccactggctttcaaatcgattggcacatctttcgtcgttgtcgcctgcgtaatgggaatatacaccgacgtggtcgaaggcgtcaagacaacgttcaaattttgaccgttggcatctaatgcttcaatgatagcctgctggttcacggatttctctaaattcttgttggtattaacgaccgcaacgactttcgcgactttgctaacttcgctgacggcgcccgtaactttgacagatgatgttccgagccgtgccgatccaacttcataaccatctgctacgttggctttattgaagtctgcgctgaccttataagtagccgttcgtcgtggctgaatattaacatgaatgtacttttgactaagtccataactcaattctttattcaagccatcgacttcgactttgacactgtgccgcccaactgccaacttagataaattagcataaactttaaaattctgcgtgttagccgtagttgtgactaaagcagacggcccttcgatcgtaactttaatattttcgggatagcccgttacaaaatatttcgtactattcacgttcagttctaagggcgcgctaatggtcactttacggttagatgtcaatgtcgttttcgatgaactattcgtcaaaatactggcgttatgcgttgtctttaacgaattaacgtaggcgaagagcaccaacgcacacagcagtgctagtagccgcattgaccaattgctattcataaattttttcattttcggggacctcctccgaaaactcgtccaaaccaattttgaagcgcgttttgcttggttgaatcctcaggcgttagtaagacttggcggaaataccgtaagtaattttcacgcgtcatcccccgcatcagctcattgtccttagtaatcgacacttcaccggtttcttccgaaatgacgatggtgagggcatccgttacctcactgattccgaccgcggcacggtgccgagttcctaactctttaggaatcagattgctttcagataatggcaagtacgccgccgcaaccttgatttgattatcttgaataataacggcaccgtcatgtaacggcgtatttggaataaagatattaattaataattcgccggtgatatcagcatctaatgcgatcccagtctcgatataatcctcaagacccgtgtccatcttaatcgacattaaagcgccaatccgccgtttagccatatattggatggccttatccagttcggcaatcatccgctcttcatcttcattctgacgcttaccacgcgcaaacatggagccacgccctaaatgctccaatcctcgccgaatttcgggctggaatataataaccattgcaatgactgcccagttaataatttggtccataatccacgataccgtgtccagaccaatcaaaacactcacagctttaataatcgcaatgacaacgatcccgcgaaacagttgtacggctttagtgccccttagcaacacaatcagctcataaatgacaaaccataccgcaagaatgtcaaggagtcggacaaagttttgtaaggtcaacaaaccgctccaattgaaagtcattagtctcctcctcatgaaaatcatttactttcacattatagcacggcaacccggttctcgcggtgcgatttcagcagagcctgcgctttttagctagattttgaataaatattaagcttgatgttatttaatattgcttgattaatatttctgttagaattagtaccagaagggaagtgactaaatgactaagttacagcggtggtttgtgcgactcgcattctggggatttttcatcttcgcagcagtcgacttgcacggcgcgttccattttctattacttaattcaattttggcttatgtcccgatcgagctgagtttttggctgacaccccgacgtagcccgctattattttggctgattgcggtcatttggttgcttttctatccgaatgcaccgtacttaatgactgatttattccacctcagcctattgaagccgtatggcatcaacggtctcttgcgcttcgacttaccgatgtggcgggatttcgcttacttggttgggccaatgatggtgtctacaatcattggtacctggggcgttgaccgaattgcccagcaactgacccaacgtttacacttccagcgactccctgctagtcgtggtatcatctgtgccgcactcttcctatttgctagtgtcggtgtctacgttggccgattcctccgactgcactccatctacttactaattacgccacagtacattgtgaaacaattagttgaaatgtggtcgctaaagatgctcgcttttgtcttgatgatgtggttacttcaactcctcatctacgcggcttggcgattcacgatgccaacggttccttatcaaacaccggataagtcctagcgtaatcaaaaacaccgtttgaactgatttgataatcagttcaaacggtgtttcttattattaactaaatattagctaattcttcgtcttaggatcactatattcggtatgccgcccccgcttatcatgcaacccactgaagccactgaaacccagttcggtagccttttgttccgcatcgttgatataacgcaacgtatcgcttgcccgtttttcaccatagacttggacccattgatgaaaacgttcctcggaagccgtggtgatttcctgttccactttatgaccagcaggtgttaacgataagtacttgattcggcgatcatgcgtattcgtggtctgttcaatgtacttcaaatctaataacacgttgatttgacgtgcaatcgcactccgtgaaacccgctgctctttcgcaatcttgaccaacgtcagcggctcctcacttgttgcaatcatccgcataaccgtgtaggcctcaaacgttatcttatacggccgggtcggcactgaaacgaagtccccgacatattttaaaatatgcatataagtgtccacgaagcgttcatgaatttctgattctgtcataatgatgtttccccctgtaaggctgcccttattcgtccgcttaagtaatgattaatttgcaaacctaaccattcaccgtcaatactactctaacatcattataacctagaactactgatttacaatctaaaaagttaactaatcttcatcggcctcaatatcattgagcatcaataagttctccgagtaattaatgaactgccgtaactttgccgcggtgcgtaaactaatttgtccactctctaacaaatgctgtacacccgcacgttcggcaccaagactcttgatgcgtagtccatgcagctgttgttcataatcatcacgtgataacgtgtgatcatttttcgcattctcgatgcgattccggtaatgaacgatcaagtgatacagagcctggcgatcaaactgttgctcatcaacgttggcctgtttgagatactgcgacaacgctttaatagcagctttagaagcttcacgctgaatatccaacaacgccactcgtaattcttcgctatcgccaggtgctaaccatagtcgaatcccttgcattgcacgcgtcaacaacaaccgtaatgagcgcagtgtcggaagcccctgtcgatgtgtcgcctgtaagaaacgttgttcgcgccgatcgacacgccgcaagtagacctgtccagctaacttactagtttgtttattggcaatcatttctctaactgctgcccgttcaccattcagtgccactaagcgaagttccaattcatctgtcagcatcggcgccaactcatccgcagtctgcgacgccacttctagacgccgaatctgaaactgctggtccaggatcaaatcataggccgcacgttggttagctggccgccgatgttcttcaatattttgaatcgctaactgtaagatataaatgcgggcttgcttgtatgttaactgtggtaattgcccactgctatcatcaccgtcatccgttccgtctgccaagaccgcgtcgtcttcatccggactggatccccgagtaacaaaggggagagatttggccgccatcaatggcaaaatagccgcagcagcaactaaacttacaatgatgactccagccgcaatgaacagtacgagcgcacgttccggaaaggctttgcccgaggccaccacggttggaatcgtgaagaccccagccatcgtaatggccccccgcacacctgataaaccggacaatgctgcaattctgagactaggtttggccttcttgtgatgtcgtaaccagttgaacaacatgtaagcgtatgtccaagcaacccgaatcagtaacaaaatcccccagacgattaaaacgtcaaagaccgcatgaaacgtatttgtatgcgcgcctttaatggttgcttgcgttgctgccggcaattcaataccaagaatcaggaagacgatcccattcaataagtaaacaaccacgttccagacccgttccgtcactaatcgtaattccggcgcatcttcactttcatgtgaattttgcaagtgcgataataccccggccgcaacaacggcgacaacaccggacgcgtggaaccattcttcagcaatgaaataaattgcaaacggcgtgagaatctgtaacaccacgttgaacacgatatcgttgataccctctcgtcgtaacacgtcccgaatgagttgaatgatcgtgatcagcgccagcccaacggccaaaccgaccagactaatatagaagaaatccccaacagcttcaccgagtacaaacgtaccggtaaccgctgctgctaacgcatatttgaacccaattaacccactcgcatcattaatcaggctttcgccactgaccaagtgcaaaatttctttaggtaacttgaccccttccgagatcgactgcacggcaatcggatcagttggcgataaaatggccgccaacgcgattccaacagcgagcggaatcgttgggatcaatacgtgaatcaaaaagccaccgagaatggtggtaataaagacgaggacgattgcattcgcaaaaattgccccgcgtagttcccataattcctgttttggaaattctctgccatcgttgtacagcatgggcgcaataaagacgagcataaaccaatccgtttgcaattttacctgtacatttaataataaagccactcctagacccagcccgacttgaattaaactgaccgggattgcgactagatagtggctcaatacattcgacagcagcactaaacatgccagtaaaatcactaattcgataatcggcatctagtggttgccccctttgttaaattgacataactaaccttgaacgacgtcttcaccaatgattcggacttccgtctgaagatggacgccaaaccgctcaaatacaactttctggacgtagtgaatcatatccatataatcggtcgctgtagcgtgatcgacattgataataaaacccgcgtgtttcttagaaacttcagcaccaccgattcgatggccttgtaagccagcatcatgaatcagtttaccagtaaaatacccagttggtcgcttaaaaacactcccgcatgatggccattccaacggttgtttggctgctcgcaacgtattcaattcgtccatccgcgcttgaatcttggtctgattacctggcttgagaccaaacgtcaccgatacgacaatatcatcatagtcctggatcgtactgtgccgatagccaaaatctaattcgtcatgatccagggttttaagctgacccgctggcgtcaaaaccgtcaccgtttcaacaacttcactcatttcgccgccgtacgcaccagcattcatgaaaatcgcacccccgacactaccgggaatcccagctgcgaattcgagaccagtcaagctagcgccacaagcaaccttagtcgtcgcaataattgcggcaccagcttcagcaacaactttggtgccactcgcatgaatttgcttcatgcgggtgagaatgatcgttaatccacggataccaccatctttgacaatcaaattactggcattaccaatcacggttagtggtaaattttgctcattggcaaacgtaatcagagctttcgtctcactgattgactttggaaacgcaacgtaatcggcgggaccgcctgttttagtattcgtataatgacttagtgattcattttttttaatttcgatggctggaaaagtggccaagacatctttggtcatggtgaaaagttcctttcgtgtttcgatttaattcacttacgttaataatcactttaaccgcatagcgtttttaatttaggccgacgtatcaagcaccgcagcattgaaacgctattgaaacgatataatcaggttgaaatttgtaagcctatcagttaattttagcactttttaatcacttaataaatgacggcacaccgcgtgactggtaattgcgccagttgggtcgactggattaggcccgtgcgttgttaccgccgtcagaaaagcacggatcagcggtgcaaatcctcgcttttccaatgtcggtgtccaatccggaaaagccgtcgtggtagttgttgccgtcgtcatcacggttttagtacttaaatcagtcacagacgcacgttgccccgtcgtttggactgtcacttgttccagattgaccccaccgtacatattcgtgataacttctaattgctcatgagccgtctgcaccgtcaaatagccttgcgccaacgcgccagttgccgtcgtcgtcaaccgaccactagtgtgttcaagtggttcatctaacaagaatagccccgtatcgaccatgtggatcatcaggtcgaaaaccgccgtttcaggatcttgactacccacttcgcgaaccttttcagccactaacatccgtttgtcaggcaatgccttcaattgctgattaaaaggagcaaaacgccgattaaacccacaagtcaataacaggtgccgcgccgcagccaaatcatacaaactttggaccacctgaagatcagtcgcgactggcttatcgacataaacgtgaatcccagctaataacaactgcttgatgattgctgcatgcgtgtccgtgggagtatgcacaaatacggccgccggtttaactgccattaattcctcaagggtcgcatgggtgtgttgaaacccatacatcgtcgctagttgtgctcgcttttccggattacgcgtcgttagatgaaattcatactggtcttgcatcgccgccatgacgggtaaatacgccttttgagcaatgttacctaaaccaatgaccccaatttttaacatcgatattcctccaattttatcatcaatcttcttttagctactactgattgctccgtggcacactgatttaaatcattcagcgtccaattcatgccagtgattgttagctggaaaaacgtgccatcactgaaagccaaagatacccgctcggacgcgctgaaactaggccaaccaaagacaccagcatgctttgtcaccctatcgcacatctatccgccgtgtctggctttaatcacggcgcactgattcaattgtcattaaaataaccagtggctgccgtgttacaatatgagtaaattacttgaaaggtctgaaactcacgtgaaacttatctcttggaacgttaatggactgcgtgctgctgtcaaacacggctttgtcacgacttttaatgagctcgatgccgactttttctgtgtacaagaaacgaaattacaggcgggccaaattgaactggacttcccaggttattatcaatactggaactatgccgagcgcaagggttattcgggtacggcgatttttaccaaacacgagccgctcaatgtaacttatggtatcggtgtaccagaattcgatgacgaaggtcgcgtcatcacccttgaatatgcggactactacgtcttgacgtgttacactcctaattcaggcggtgaattaaaacgtctcgactatcggcaacagtgggaagatgcttttctcacatatattaacagtttgagtgccaacaagccgttgatcttttgtggtgatcttaacgtggcccacgaaaacatcgacttgaagaactggcgtagcaatcaccatagtgccggcttcactgacgaagaacggaccaagtttgaccgcctccttgcagcgggctataccgacacattccggcatttctatcctgaccaaaccgacatttactcatggtggagttatcgtgggcatgcacgtgacaacaattctggttggcgaattgactactttattacgtcacagcaattagacagtcagctcctaaacgcccgcattcataatgaaatttttggttccgatcactgtccagtggaactcgatattatccttccgaaccattaacttgaaaattaacgagattctttgtacgataatcctattctttagaaacggtggtggcaactttgaactttgtcgcaatggactttgaaacggcgaacgcgaaacgcgacagtgcttgttcactggcgctaacggttgtccgtaataaccaaatcagcgatgaattttacacactcatcaaaccagagagcgattttttctggcggaacgtccaaattcatgggattcatgaagcagatgtcgcagacgcgcccaagtttccagacgtttggcaacacattgaaccatttttccaacgcgaccgcctcgtaattgcgcacaacgcgccttttgatattggtgtgttacgcaatacgcttgcccactacggcatcagcgcgccggagtacctatccatggacaccgtcaagaccagtcaacggttctatccagaattgcctaatcacaagctggatacagtctgtcaagcattggatatcgacctgcagcatcatcataatgcactagatgacagcctagcttgcgccaacattttactcaccgaagcgcaagcttttggaaccgagcaactcaaacctttcgttcgcgttcagggttaaaattaaatttatgcaagtccagcaataagatgctggacttttttgtttacgcatcactaccgattatcaatactcgtagacagcttatcaattcccccaaccgactgggagatgagccaatcattcacaagccgtcgccggttaggcctggttcgtcaacgcttaaattccggcccatctactatcagaacctgtttgccgtcagttcagcgaatcccggatttcaaacccagattcccatatcaatagctggaacccgtttgccggttgggtcaacgacatcatagctcgttgccgtacaattttcgaacccaagatgctggtacagcttaacggcacgcacatttcgtaactggaccgtcaacacgaggcgttccaatgagctatagttacgcgcccaatctaagacttcctcaatcaaagcagtccccagacccatgccccaaaattctttaagtaccgctacgccaacttcaccttgcgccgcactaaaatccgtactagcttgcacggtgctcacaccaatcaaccgtgaatctaatgtcgcaacgaaaataatgttggtcgttgtgccattgatacgctcaatttgcgcctgttcatccgtttcgctcaaatcctcaatgccctcatcaacagtgaaagtattactttcacgtccgagctgagcgagtagcgctaataattgtgctgcatccgcgacttcagcaggccgtacatcaacaacttcttctgccatggttgtcactccttcaattgatcaaccagtcgttgatagtgttcaccaatgggcttgaaggttattacccgctggtcatcggcatcagtgtcccggctaattgcaattcgcaagtaagtcgtcggtaagaggtcggcaataaactgtgaccattccacaacactaacgccatcaccatcaaagtattcatctaagcctaaatcttccgcaccgccatcttccaagcggtaaacatccatatgatagagcggtagtcgcccctgacgatattcccggatgagcgtaaaagtcggactcttaacgttattaggaatgcccaggctttttgctaacccctttgtaaaagttgtcttaccagcacctaaatcaccatctagtaagattaaatcaccaggttgcactaattggccaagtttggccccgattgccatggttgcttccggcgacgttaccgtgattgattccatattcttccaactcctcatccaaattaactgttcttattatagaaaaaacgaaggaaacttcaaagtacaagctctgaagtttccctcgtttaacaaactaagtgaccgtttaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagcagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatgtgataaccctccaataaattaattaatgctcaagattgacgtgctctggtaactgccaattgattggctgttcgccgaaggatgttaacgcaatgttcgtttttgaaaatggtttggacccaaagaatccgcgataagctgaaagcggactcggatgaggtgcttgtagcacgacattcgtctgggtatcaatcagcttaatcttggaccgagccgccttaccccacaagataaagacaaccggcgtcgatcgttccgataaacgctgaatggcaacgtccgtaagtcgttcccagcccttaccagcgtgtgaaaaggccacaccattttgaacagtcagcacggagttcaataacaggactccctgcttggcccaactttccaagtaaccgtggttgacgggcgtacacccaacatcatcttgcaattctttatagatattgactagtgatgggggcactgccacgcccggtaacactgaaaaactcagtccgtgtgcctgaccaggaccatgatacggatcctgacctaaaataacgaccttcgtgtcagcaaatggcgtccattcaaaggcctgaaaaatattatacatatctgggtgaatatttttcgttcggtattcatttttcaaaaattcgtgtaattggtggtaatacggcttctcaaactctggttttaagacgtcccaccagtccgtgtgaataaacgctttcatccttaacacctctcgttttattgtatcataaccaaaaccactaatgataataattctgtattcagacgtaaacatgttagaatgtaattattaaaacaactaaggatgtgacaacatgatttcgattatcgcctctgatatggacggaacgttactcaacaatgaaatggtcgtttccgattttaacgctaatgccatccgtcaagcacaacagcaaggcgtgcactttatcgtctccaccggccgccgattttctgaagctcagccactactggccgctcaaggcatcacggcacccttgattacgttaaacggtgccgaagtatacgacgcttctggcaaaatgctcgacatggtgcccataaccaatagcgtggcccgcaccgtttttcacacgctaacctcacaaggttactattttgaagtcgtaggcaacgatggtatttactctaacagtaaagccaagcgaatcgaacaaattgcacatctcctaactaacctgaatccagatacaacgttcaaaattgcggtatcgctcgcgtcagcccgcttagaacttatggacatcaattacgtggacaactataacgagttattggatgatccgactaagcatgtcatgaagattatcgctttcagcgaagaagggcctgctaagctaaaaccccttagtgatgaaattctggcaaaacattcgtccctcaaaatcacatcttcatccgcatcaaatatcgaaatcaataatattaatgcgcaaaaagggattgcagtcgagcgctatgcgaatatgctgaataccccaatgagcgatgtcatggcgattggtgataataataatgacgtctccatgctcgaattagctggcgtaagttacgctatgggtaatgccagtcccgaagtcaaacagttggcccgctatatcactgatacaaatgtcaacgatggtgtcggcaaagcaatcttagaagtgcttgccaaacaatagtttccggaaaacggaggttgaagatgcgtaaattatatttcagccgcaatagcttcgcccaaggtgcccggattgttcgcgatgcgcacaaccaatctcactatctcttagttggtcggtgggggcggcgccaagacgcgctcagtttatacgcgatccaaggtgagctacttgccgaaattcgacaaacaaccctcggattgttgccaaaattcgatttatactataaccgtcaaaacgtcggttctattagtaaaacgctgggcttctggcatgaaatgctctatgttcgcaagcttcgctggattatcatgggaagcttgagtgccgaaaactaccgcgtttatcatggtactgaattaatcatgacgatgcgaccagttgtcaccactaacggtgaagcatttgaattagcaattactgatcaatccacagaaccactgtgtatttgcattgcggcgatcctggatcactggcaaaagccgaccaaccgcgcgcggacaccaattgcgaaaaagggactcaatgttagctttggtgaaagtaattatacattgacaccccgtaataaggtgccccaacactaaatagaactagccataaaacaacggccacccctgtttcgggatgaccgttgtttttagttaagttggcataactagtttgccagcttaacaccctatcaaagttgacgtgccgatcaagttgcccatatcacggtattcactagttaatcgtcctcagagcaacaccgcttcatctgctatgcaagcacgttactacagaataggcgcgccaagaattaaaccaattcttagcgcgcctatttgacgggttattttattatgaccagccgatacttaaacgttgatcactttttgtaagaaatcttgtaaccggggactttgtgggtgttcgaatacatcctcaggcttccccgtttcttgaatcaacccatccgccataaagacgacccggtcggccacttccttggcaaagcccatttcgtgcgtgaccacaatcatcgtcataccatctgcggctaatttcttcataacatccaacacatccccgaccatttcgggatccagtgctgaagttggttcatcaaacaacatgattttcggatgcatggctagcgctcgagcgatggccacccgctgcttttgcccaccagacaaggacttaggcatggcatccgccttatcggacaagccgaccgtggcaagtaagtcacgcgctgttttctcagcttcctgttgactttcctttttgagttgagtcggtgctaaggtaatattttgtaacactgataggtgtggaaataagttaaagtgttggaacaccatcccaatattttcacggaccaaattaatgttagtccccttgtcagaaagatcataaccgctaatgacaacttgcccttgtgttggaacttccaagtcatttaagcagcgtaaaaacgtactcttaccagaaccagatggtccaatcatgcagactacttcgttatcttgaacttcaaggtttaaccctttcaagacttcgttatcgccgtagcttttatgcaaatctttgacaattactttcgccatgcttagttaatcctcctttgaacccagttagataaccatgttaataacgtaatgataatcagataaataatcgcaatcattaaccaaatcttaaagccttcgaagttccgggcaataatcaacgtcccagtttgggttaattcaacgatcccaataacggatagaattgacgtatccttcaacgtgataataaattggttaatgaacgacggaatcatgattcgaattccttggggcataataaccttgcgcatggccgtccagtatggcaacccgagtgaacgggccgcctccatttgaccatcgtcgaccgcggcaaagccccccttaacaaaggctccagtataggccccttcgttaagcatcaacgtaatcatcccagcaacgaacgcgggaatcttaaagccgtgcccaatcaggtctgggaacccaatgtaaataaagaaggccaacaccatcaatggcatcccacggaaaatataaataatcgtactggagatggccggaccaagtttacccggcataacgcctaagaccccaagaatcagtccgaggatcgtcgctaaaataattgaaataaccgttaattccaaggtcatccataaccctgagccaatcgtatccaagttttgggtgaacaagccaataaaggtccgactgcttgcgtcttcacccgttaaggatgcttcactagacttcaagtacttgttaatgatctttttgtaagtaccatccgctttaatcgctttgagacccgcgttaaatttctttaacagttccgcgtttttaccttttttaacagcgaaaccatagtcgccggcctcgtgttgcttggaaacaatcttcaacgcgatgccattcttgattccgtatgacatcacgggatagtcttcaaaacaagcagccgagttgccgaccttaacatcgttatacatgttattcgagtcattgaaatacttgattttgaagccgtacttgctctgaatcgacttcgcataggttgcaccagctgtccccgttttaagggccacggtcttacctttcaaatctttaaacgttttgaccttgctatctttagccacagccatgaccaccccggaagtatagtaagcgtctgaaaaatcaaacgtctgcttccgttcagccgtaatattcattccggcaatcaccccgtcaacttggttcgcactaagctgctgaacggcggcaccgaaactaagcgcttttaatttataattgaaattttcttttttggcaattgccttcaaaatatcgatatcaattcccttatacttaccacccttgacctgaaattcgaacggcgcaaaggttgtatccgtcgcaatcgtatacgtcttagcctgggcctgggtaccaatcgcaaaccagcttcccaacgctgctaacaacatgacaactgcaacttgccactttctcatcgacgagacctcctcaaatagtttaccggaacggtatgtcataaaatataacataattcatgtctcgcgaccaattcaattttttatacttttttaatttagctttaatgatgtcgctatcatcagctgtttacttaataaaataaagtaaatagtcatttctagcaaagattctgatgaaagtaccccctttttatgttttaaaattttgttcaagcattaatcactgcttaactgaatacttgacactagattcatcaacccgcgcaaccagccgttaagtccaaacagcagcagttaacaaaacggaccaattcaaaatgaatcggtccgttgcaagaaatcgctatcaattttagctaatcgatgaacttaacacgccaatcgtacgcttaatcctcatgcgtatgccgccgacgtcctaatcccattaaccctaataatcccgttaatccgagtactaccgcgccttgttgtgctgagcggtcgcgctcgcccgtctgtggcagtgtgtcagcagtcgtgtcagttactcgtgtcacaggtgtcgctgctgctttggctgcgctagtatgctcattgttggccggtagagctggctcagcggtcgtcttgaccttagtctgtgcacgagtagccgcggccggttgttgctttgtcgtaatccgatcatcaacgccccagtcgacggtatgaccatccgaatcgttaagtcgctcactcggcttcggtgtttcactaggatcagcgatacctgcatgatcattgccgtcagggttagatgtttcgccgtgatcattgttgtcaggtacggtcgttccaccatgatcattgttatcagggtcggtcgtgttaatgtgatcatcgtcaggtaagacgacggtcaccacggccgttttagttaactgattaccggcaacatcagtatagtggtaagtcaacgtgtactggccagcgcgttgtgtgttgaccgtaccatcgaccgcgatatcagctaatgtcagcgcttggccctgggcatcggttgcacgttcgaaattatcctgagcagcccaagtgtttccgacggtcaactgactatcacgcacttgtaactgggcctgactagccaatacatcgatactcgtcgtgacagtaatcagattacccacacggtccatgtaacttagtgtcagtgggtaattgccggcccgccgtaagttcagggtaccatctacagtcacccgctggcgctgcgctgctgtcagcaacgtgccatccgctgccaaactcgttgaccagtcaacactatcattcagtgaccaggtcgtcttagggccggcaatcacggtaactggccgcgtactgattttagcctgcgtggcaacggttgtcacttggaccaacgccgtttgttgttgtcccagcgagtccgtgtaaaccagttgcacagtttgtggctgcccaatatgggcaaccgttaagtctggcatcgccacgactgtaatagcggcattattgaccgcaatcggctggcccataccatcagtaatcgttccaataccctgatgataatcccacttggcagtcggacccgcgatgaccgtttgtggctgagtcgttaatgctgcttggtcgactgtcaccgtcgtagtcgcagtttttacgttgcccacctcatcagtatatgtcagggtgacttgttgtttcccagcctgttgagcattgatggtcgtcatcgtaacactttgataattttgactagtctggccccaggcgtccgttaaaccagtgactagatccgcaaccgttaattttccgacaactgcaggccagatcacctgatcagcactagtcgtcatgtgcgcccgtgaggcgactgttgtgacctccgccgtggtggtttgggtcaatcctaattcatcagtgtaactgaacgtaacgacttgaggccgccccaccatggctgtactcaagtccgggcctgtcaagactttaagattggcatcaccgacattaatcacttcaccggcagcattcgtcacggttttaaagttcgtctgataatcccaatgggcagtcggcccggcaaccggtcgagcggtttgggtcgttaaggcggcttgatcaaccgtcacttgggcagttgttgtcacctcgttgccgtaatcatcggtatacgttagagtcaccgtttgggcaccaggctggctggcatcgaccgcactcatcttgacattggtcaaagacgacacttgagtgccatccgcgccggtaatcgtttgcaaaaagttggctggcgtcagtagccccgcatctttggcccatacaatctgtgccggacgtggcacgagtgccgcctgtgatgccgttaaggtcaaagtagctgacacagtatgtgtctgttgtagatcatccgtgtacatcaaggtaaccgtttgcggcttatcgatcattttagccgttagttgcgggccggttatgaccgtaatcttagcttgatcaggattaaactggtggccttgcgaatccgtaacagtcgccaattgttgccgataatcccaagtcatacttggcccccagatttgagtccggttctgactatcaatcttggcctgatcaaccgttacttttacaacggtacttacttcgttaccagccgcatccgtataagttaatgagacgggttgaacacctggccaggtcgcgtctagcttagacatccgaacgatttgataatcagtcacctgttgtccagaggcgtccgttaagctcgttacaaggtcattagccgttagcttcgccgcggcatccggttgcacgataactgccgccttggccgttaacgtagcttgtgaggcctcagctgtcaccattgccgtgaccgactgggatttcccgagctcatccgtataaatcagtgtgatcagctgttgttgcccgactgaatcaacattcagatctggcctgttcaacactttaattgtccccggttggacggtaataagttgcccagctgcattcgtcaactgactaataccggcttcgtaactccacgttgccgtcgggccggcaattaccgtacttggttttgtcactagctttgcctggtcgactgtcacattggcatacgcgacggattgattacccgcaacatccgtgtaagtcaacgtcaaacgttgctgccccgctaacttggaatccagcgcactcatttcgacattgtcgtaatttgtcatcagatgaccttcagcatcgtataaacgatcaactaagtccgttgccgtcagttgtttagcttgatcaggccaaataatctggtcagcaacagccgtaatcttcgcctttgaaagcgtcgtcgttacaatcacgtcggtcgtgtgaactttacccagactgtcagtataggtcaacgtaaccgtttgtggcttgccagtttttgccggagttaaatcaggcgttgtggctgtaatgtcagcagtatcgacatcaattgtctttccgttggcatcgatgacttgagtgacgctgtcccggtaatcccaagtcgccgttgggccggcaattgggtgtgtcgcttgaccagtgattgtggccaaatccacggtgacagtcgtctgagcagtcgtctgattgccatacgcatccgtatacgtcagtgtcacggtttgcggcccgatagctttaggatcaaaaccactcatcgtcacatcatcaaaattatgaatttgaacgccatccgcatcgtacagtgccgacactagtgacgacgcagtaaccatgttcgcgttttccgctaaaattacttgcttggaaacggcagtaatggacgcttttgaagccgtggcttcgacattggcagtctttgtgtgtacttgtcctaaatcatcggtatattcaatcacgattggatacgtaccagccacacttaaatctggatgttgaacgaccgtaatcttagcattgcttaatgttagcgattgtcccttagaatcagtgacggctttgatgttatcagcatagttccaagtcgccttagatcccgccacttgagtgtgattttgaagcgttagcgttgcgaaatccacggttacagtcgtcgaaacagtcgtttgattgccatacgcgtccgtatacgctaacgttactgtttgtggtccgatagctttagcattaaagccactcatcgtcacatcatcaaaattataaatttgaacgccatccgcatcgtacagtgtcgacactagtgacgacgcagttaccatggtcgctttttctgccaaaatcacctgcttagaaacggcagtaatggccgcttttgaagccgtcacttcaacatcggcagtctctgtgtgcgcttgccctaaatcatcagtatattcaagtacaattttataagttccagccacacttaaatctggacgttgcacgaccgtaatcttggcatcgcttaatgttagcgactggcccttagaatcagtgatggctttgatgttatcagcataattccaagtcgccttaggtcctgccacttgagtgtgattctgaagcgttagcgttgcggaatccacggttacagtcgtcgaatcagttgtttggttaccatacgcatccgaatacgtcagtgtcacggtttgtggcccgatagctttagcatcaaaaccactcatcgtcacaccatcaaaattcgtgattttgtttcccgccgcatcaattaactcgctgaccaggtcagttgccgtcagctttttggcttcatcaggtatgataatctggtcagcaacagccgtgattttcgcctttgaaagcgtcgtcgttacaatcacgtcggtcgtgtgaactttacccagactgtcagtataggtcaacgtaaccgtctgaggcttgcccacctttgccggagttaaatccggcgtcgtggctgtaatgtcagcatcgccgacatcaattatctttccgttggcatcgataacttgagtgacgctgtcacggtaatcccaagtcgcggttggaccggcaattgggtgtgtcgcttgaccagtgattgtggcgaaatccacggtgactgtcgtcgaatcagtcgtttggttaccatacgcatccgaatacgtcagtgtcacggtttgtggcccgatagctttagcatcaaaaccactcatcgtcacatcgtcaaaattcgtggctttatttcccgccgcatcaattaactcactgaccaggtcggttgccgtcagctttttggcttcatcaggtatgatgatctggtcgctgacagccgtaatcttcgccttcgaagccaccgtgttgacaaccgcagtgactaagtgttctttgcccaactcatccgtataactgagtgtcaccgtttggtcatggccgaccatcgcaacacttaaatcaggttcagtaacgactttaatatcagcggttgcgagattatcaagcaactttccatttgcatccttgacccattccaaaccagctagatagtcccatttagctttaggccccgcaattggattcgttagcttggtcttcaaatctgattggtcaaccgttactttggcataagctgtcactagattgccagcttcatccgtataagtaatagtaacggtctgcgcgccacccttgctcgtgtcaattgaactcattgtgacatctgttaggtcggtgctagtatcgacggggttcccgttggcagccgtgattgtcaccaaatcggcgacttttaattgagcaacctcactgggccaaatcgttaacggcgccttggttgtaacttgtgcccgagaagcaacgactgttacttgagttgggacgctgatgacattgcccaacgcatccgtatacgtgagtgtgacagtttgcgacccaatttgcgttaaatcaggttgctgatcaaccacaatgttaagtccatctaaactaaccgggttcccatcaaaatcagtgacactcgtgacatactggcggtagtcccaacttgagttttggggtcctttaatgatagtactattacgcattgttaagtcggccttagttgcgaccatcgtcaccgtggtggttgtcgtgtggaccatgccagtagcatcatccgtatacgccagcgtaaccgtttgtgcgccagctttactcgtatccaagcctgtaaccgtagccgtcgcgagttcgtcagcacttagcttatcgccggccgcattgcgggagttgtccgtgtcgattaaatcattaatcgtatacgttggcttagcacccattttgatcgccaacggtttaccaactagtttgccttgatttaccgctaccgcaaccgtactagtttgctgccatactttgccatacgcatccgtatactgcaagtcaacttgataggtaccggcagtttgagtgtcgaccgtcgttacagcagtatcgccgttcacgctaatcactttgacgactgtgtcagcggtcgcataaatatcggtcccattcacatcttttagtgttgcaacactatcggcaactcgccacgtcgtcttcggcccggcaattaatccggttacattcttggacgtgaaatcagcataggatgggctagtttcccagacccaagtgattgtatcggctggattatcgacgccattatacaaagccattaactcactcgacgtatacgtctgggtggcatcagcttgattgacccatttaccggtatagccagttccagttggaatgtctggcaatgaactaccgactaaatatgtttttgacccaaccgttaatgcgtttaggttcatgggcaacggattcccgctactatcttgattcaaaaacatatcatgatctgcaggttccttattcatatcagcttcagtgactgctgcaaagttagacatgtccaaactcgcaatgttgattgcctttaatccaggggttccctcaaacataaacttagtactagttaacgtactgcccgtctgccagcccgttatatcaagatcagtgagattggtatcatttaaaaacatcgatgacaacgctgtaacattcaacaagttccagccatgtaaatccgccgttgttaaactcttatctccattgaataacccatctatatccgtgaccatccgcacattccaagtacttagatcaatactggtcaaggccgtgttaaatgaaaacattctttttaagctcactggttgaaccgtattcaactgccactgacttaaatcataagattgaactcgcgagtcactggcgaacatagagtcaaaggacgtaccagaactgacattccaatgcgctaatcctgagaagtcagcaatcttagttcccataaacatcattgaaaagtcagtgactttcgaagtatccagattttcaaggccatcaatactggccaaatttggattataccggaacatataactagtatcagtccccgcattaattggaccatcaatcactactttcgttaactcactgccaaaatcccccggtacgtcgctgacatcacccactccggtccaatcaccagcatgaatcgtcaacacaccatcatctgtgtactgccaggcacttgttcccagagtcccagttgagacaacaattgcgggtgtggcggctcgcgctaatagtgcccgatttaactggactttatcgttagtcgtcgtaattgtattagttgtggcagttacagctatcggactagtttctgaatccacaactttttcagtttcattagaatctttcgagtctgagtcaccaatactggccattgtgctagtacttggcgatgcgacacttgaacgattagtttgtagtgattcatcagccaccaccgtgtccgtcacattagattgaatgccactctcagagcccgttccttgatcattttgataatcagaattttgtgttgtgactttctgtgaactcgatgcgacacttactgagctgtttgacgtttggtccaaactgtcgccagaaccagttttagcctgactgcttgctgatgccgaatcagaggtactgagattactggttgcgttttcattttctcctactgccgtaaccggttgttcagcctttgagtcagtagtggtgccactaaccgcctgttttttttgagcactagtatttgttgttgccgcattaatcgccgtcgcactagactgagtcgttgcccctgttgtactagtcgtagtagtccttaaaacctgtgagttggatgatgaggatgccccagcagtggtcgtagctgcggtggctgcggtcgtcgtttccgtatctgcccgacttatcagtggattcagagtaaaggtagccacggtaataccagcaaatacccagaaacgtccctttttatacattttataatgctgcttgctcgttataaatctattcatacatgtcccccccaagaatccatgcaataaatcatatcaaaattaacttattatcaatttgagttatactaaatctgattaatatcagaataataacattctccaaagtttagtatcaattatatttattgaatcaattaataaataacgcgtttaactatcaatacaattatatgctaacataattaccagctaagtcgcaagtgcttgtacccgacctttcgcaaaatatttatagcctgataaccattttgctagtatctagaacatttataacagtgagcactacatcagtacatataaaatatatgcttgccgtcgtccgtccacggcacagaaccaccaacaacacatactaaaaaaggtcttccaagaatcgaattaattcttggaagacctttttatgacgctgccatactcgttgtatggtgcagcgatgcaacgctaacgtaatcgatgcctagtaatgtttcataacccggtcgatttgacgctgttgttcgcgtttcttgatatcttgccgtttgtcgtattcccgtttcccgtgagcgactccaattaagactttcgcaaatccatgcttgagatacatcttaagtggaataatcgtcacacccttagtcatcgttgctgcacctagcttactgatttctttcttgtgcaacaaaagtttccgggaccgcaacgggtcaacgttataacggttaccctctttaaacggactaatgtgaacgttttgcatccaggcttcaccgttgcgaacttgaacgaaaccatcctttaagttgacccgccgatcgcgaacggatttgatttccgtccccgtcagcgcaatgccagcttcataggtttcctcaacagcgtagtcatggcgtgctttccgattttgagcgagggcggtatctgggtgcttaccgtgttgtttggccattgccgcacatccccttacttaaaaattaacgccgacgatcagttgatgaccgccgattgttgttagtactatgattattattgttgctattatgattattattgttccggcgaccattgctattgccattacgatggttattgttgttgccaccacgatggtcgttattccggttattattgttcccatttcgccggtagttaccgttattgccaccacgccggttattaccacgatagttatcatgatgttcccgctttggcaataaatcagtctttggcgcttcttcaggattcaataacttaaagtcgacttctcgttgatccttatcgacccgcattagttgaactttgacgggctggccgattctaaatgtccgtttcgtcttacgaccaaccaacgctaattgtttttcaacgtattcgtagtagtcgtcgtccatagtactgatatgaactaagccttcaacggtattttctagttcaacaaacagaccgaatttcataacggaatcaacaacggcttcaaacgtctcaccaacgtgatcagccatatattcagccttcttcatcgaatcaacgtcgcgttcagtatcaatcccccgccgttcatgatcagaagtcgtttccgcaatatttggtaggttatcccgataacgtgcccgggcttcttcaccagtgccgttttcagcataatggcgaatcaaacgatgaaccatcatatctggataccgccgaattggtgacgtaaagtgagtataatacggtgccgccaacccaaagtgaccaagcgactggtcagcgtatcgggcctgcttcatgctccgcagcatcatgactgagaccatggcttcttcgggcttaccagcaaccttcttcaaaacgtcttgaagcatcttcggcttaacatccttagaactccccttgacactgacaccaaagttagtgacgaattcaaagaaactaagcatccggtcactatcaggcgtttcatgtacccggtagataaacggtaccttaagttgactatagttttttgcaaccgtttcgttggctgccaacatgaaactttcgatcattcgttcagctaagccacgtacccgtaattgaatgtcaattggatgaccggcttcgtcaacgataattttagcttcgttatcatcaaaatcgatcgcaccacgatgccgccgatgcttgtacaagatacggtgtaagtcgcccatcgtatcaaacatgtcgaccaagtccgcgtacttttcacgcgtcttggggtcatgggcttcgagaatctgattaacagcgtcataagtcatccgggcgtgtgaccgaatcacactttggaaaatcttatggttaacgatttcccccgtttgatcaatctccatctcacaactcatggctaatcgttcaacatcaggatttaaggaacaaatcccgtttgatagccgccgtggcaacattggaatcacacggtcagttaagtaaactgacgtcccacgtttgaatgcttcccggtctaactcagagttctcggtgacataatggctaacatccgcaatgtgaacgcctagatggaagttcccatttggcaagcgccaagcaacaaccgcgtcatccaagtctttagattcggcgccatcaatcgttactaatggctggtccgtaatgtcgacccgaccaactttttcttcatcagtcacgtaatccggaatccggttggcttcatccgtcacttcttctggaaacactgatgggacgtcgtgttggtagaccacttgtaagacgtccatcccaggatcatcaacactcccaatgacctgcttggcaatcccaatcatccgcgttggatgctgagcgtcaggataagcagccacttcagcaatgatgacttccccctcagtggggtgtaagccctgatcagtgattaataactgatatttggataatttcttatccttaatttccacagaaccaataatcccgtcttcatccgtacttggtgtatacgcaccgacaatctgggtatagttccgtttaacgatgctgacaattttaccttcagggccgcggtcggaaccgggacgggctggtcgaatgatttcaaccgcaacatcgtcaccggtaatggcaaactgcgtgttgtccggattaatgtaaatatcaggcaaatcgggatcgtaacgaacgaaaccaaagcccttgtcattaccatgaaatgaaccttcaacagtcttcgtttcctggaccagcttgaaatgatcatgatcatcggtactaactaattttttacgttccatattcgcaagttcctttactagaaaagtaaacgccgttgcgcctgtaaaatgcaattcatccgttagttgttcaacactatacgtgcgatcgggatgagcttgcaaaaaagtcaggatttgttcttgtaagtttgcttctgacattatttacctcatttataaatagtttttaaatatgttaaaacatcttgttccaattggtgatgcgcactgttgacggtaatcacgtgtccagcatcagcataccaatgaaaatcaactggtacttgtggtaattgatcacgtaatcgtcgcgctaccgtcgcatcaattaattcatcttgcccaccctgaccaatgaagaaaggttgggtcacagcgctgaggtgactcgtaacctctgtcgtagtaaaggtattgactgcctgcaattgccgctgaaccagttccggcaacgtcattaagatctgttcacgctcggtaattgagaattgactgtgcgccagttgatggtgactcagcgtgataaacatttcagcaacgtcactacgattaccagcaaatagtggtgaactaaacgtgccaccacctagcaactgaggatcacgttccaaggccgccgtcgcaaaaataccacctaatgataagccaaagatactaattttagtatagcctttttgccgcataaatgatattgcttgttgcgtatcttgccaccattgcgccggcgtctgtgcgagaatatctcgtggatcatcagtcgcgtgtccactgaattgggggccataaactgtataatcttcccgttctaatgctcgtgctaacatccgcacatcattggcacttcccgcataggcgtgcaataaaatgacggcatgttggccatgttcaaagaaaaacggttccggttgtttcagcatcattacaccaccttaaaaaaaagcctcctgaaatcacaggaggacggtcaattacttcgatgagtaccatgctagagctaacgccaagataaagaatgcgattcctaataccacggttaccttctgcatgaacgcttcaaaaccgcggggcttctgcttggcaaacaagtcatcagcaccaccggttaatgaagacatggcatcattagttttggatggttgcatcatcaccgcaatgataatcaaaacggaaacaaccagtattaacgttaacaataaattatacaagaaatgtgcctcctaaagcctccgctatgtctataacaatttaacatattttgccttatttttccagtatcctgaacaattcgttgctttgtttagtgctcagggcgtcgcgaccgttaaatgtgcgatttgatggcgcacccacgcacggttatcccggtcagtcaagataattaaggtatcaccagcccgcatcaaggtgtcgccatgcgggatcacttgacgctccccgcggcgaatagcgatcaataatgactctgctggccatttaaaatcacgaacttgatggccctctaacttagagccttcaaagatcggcaattctaaccgatcctggataccgctatgttccggtaaccgcggctgaattaacttctctagcaaagcctcataaatcggagcgccgcctaagagatccacgactaagtaggccgtcatcgaaacgactgctaatggcatcaagtgatgtagtgtcccgaccatttcagtaatcaataaaattgcggtaaacggtgctttaccaatgccggcaaagtatccagccattgcaaaaataataaagttcggaatcaagttcgtcggcatccaaccaacggcaaccatgaactgggcatagattgcacctaagatggcgcccagtgacaagattggcaagaagatgccccccggcaaaccagatccatatgaaatggtagaaaaggtaaaccgtaacacgaaaattcctaacaaggcgagtaacgctggcgttactgcggccaaattcaaaataacagcattgccgcctcctaatagctgcggccaaattaatccaatcggaatcaccagtaaaaatggcaccaagccatccaaccaactgggcaaccgcaacttggcataccaatttggcatcgtcagcgtcacgttttgatatagataaccgaaaataccgagaaaaatcccgagcccaatcagattgccatattgactcaacggaaggttatggccgtacggaatgtgtaatactggtacaaggccaaaaaaattgagcgaaataaaattactggccatcgcactaactaatgcggtggtccaaatgattggtgaaaaattatgataaacctcttccagaacaaataacgtactggcaatcggtgcgttgaaggccgctgaaaggccagctgctgcaccaccggcaatcaaggagcgtcgatctgatcccgtctgtttgagtttcgacgcgacaccctgaccaatcgtagctcccaattgaatcgaggggccttcgcggccgagaaacagtccagaaccaatgcccagaataccaccgacaaacttgcgccagagcactgaccaccaactataatcaagctcgccagctaattgaccctcaacttgtggaatgccagaccctttaatattcggttcattcttaactaaccaacccacaaagaacgccacagccacagacaagcctatccatggaaagagcagtagccaatttgtatgaatttgtgcgtacacccattgaacgaacctcagtccctgctcgatgctgaaacgaaaaatactaaccacgatcccagcaatcacaccgacaattaatgcccggccaatcgagctgaaccgtgtaaagtcaaaatgttgttttgcaatgtgcggccgctgtgccaccatgagttccccctcttaatcatgataatcgttgtgcaatcacttgctggacggccgctaacgtcacgggcgctccaggatgtaatgcctgaatctgctgtggtccatctacgcgtaataacaaacctaataacagatccttttctaagtcgtcagtttgataagtttccttaaatccagccaataagtcagtatcatcattaaatgcttgcaaaattagcgggactaattccgtttgttttgcagcttgatgggcggcactgaatcgctgtaaacctaattcaccactagtcacaattaaattcccacccactagattgccatgaacaaattgattaggcgttacggtgtgtacttgtagccaggccgtacgctcggcaacaaagtcggggcccagtgtatcccactcggttgattgggcagcggttggcccaaatgcaggaacttcagtattaagtcgcgtcaacatcgtcccaatctggcgccccagtgttgacttagcaaggggcttagccgttgcgcaaaattcagttagcgtcagaccttgtagtggctgataaatcacgtagtagaactggtacttatcaaaaatgaagcccgcatgcaatagacgcggagcacccaagctcaatcgagccatccgggtcagtccaaaacgttccgcctgataataggcccgagtttgggggataacctcactgggtggaaaaatcgcgatttgggtgggtccgaccgtaaagcgggcggccaacttatccgcaacgggttctggcgttttataaggctcattttcactggcataaattttttgaatcaccggttcaaaagcaccggcattcagttgcagtccttgccaatcagaccactcattaatttgttgctgaaagtcatccattctgctcgctccttactcaaaatacgcatgtttctattctaccacgactcgtccgtccctagaccctaaactcaaacagatgttccttaaattatgtataataaaaacgccgtcccatcggaacgacgtttttattagaacttcaaattacttgctagtaatggtgttccgtgcagcttcgtctaagttatagaaaccgtggatacctttgtattctgaagtgctttcaagttggtcttcgatccgcattaattgattgtatttagcaatccgttcagtacggctcattgaaccagtcttgatttggccagcgttcattgcgacaactaagtcagcaatggtcgtgtcttcagtttcaccagaacggtgagaaacgatggcagtgtagccagcttctttagccatttcgatagcttcaacagtttcagttaaagtaccaatttggttaaccttgattaagattgagttagcaacgcccatcttgataccctttgcaaggtagtccgtgttcgtaacgaataagtcgtcaccaacgatttgaactttcttaccaagcttggcagttgccatttgccagtcttcccagttgttttcatccaaaggatcttcgatagaaacgattgggtacttgtcaacaatgctgtcaagtaagtcaacgaattcttcggcagtaaatgattgaccattttcgccttcaccctttaagtcgtacttgccagtttcttcgttgtagaattctgaagcggcacagtcaaaggcaatggcaatatccttaccaggcttgtaaccggcacgttcgatagcttcaactaagatttcgaatggttcttcgttgttcttcaagtcaggcgcaaaaccaccttcgtcaccaacggcagttgagtaaccgcgttcgttcaagatcgctttcaagttgtggaaagtttctgaacccatccggatagcttctttaactgaagaagcgccaacaggcatgatcatgaattcttggaagtcaacgtcgttgttggcgtgggccccaccattgataacgttcatcattggtgttggtaaaacgtgagcgttgaatccgccaaggtagttgtataaaggcatttcaagttcgtcagcagcagcacgtgcagcggcaatggaaacacctaagatagcgttagcgcctaacttagctttgttaggagtaccatctaacttgatcatagcttggtcaatggcacgttggtcagttacatcgtaaccaacaatttccttagcaattaacttgttaacattgtcaacggctttagtaacacccttgcccatgaaacggcttttgtcaccgtcacgtaattcaacggcttcatgttcaccagttgaggcacctgaaggaacgataccgcggccaaatgcgccactttcagtataaagttcaacttcaacagttgggttaccacgtgagtctaagacttcgcgagcataaatatctgtaataatagacattaatttctctccttaaaattggcttgttatttgtttcacacttattgtagaagtttgtcaatcaacttgcaataactattattagttattttgataattaacaagttccaagaatgaatcaggttgtaatgaagcaccaccgactaaaccaccgtcgatatcatctttgcccattaattcgttaacgttggctggtttaacactaccaccgtattgaatccgaactttatcagcaacttcttgtgagtaaaggtcagcaacagtcttacgaacaaccgcacaaatttcttcagcttggtcactcgtagcagtcttaccagtaccgatggcccagattggttcgtaggcaataaccaatgaacttacttggtcagctgataagtctttcaaagcagccttgatttggcctgaaacccatgattctgcttcgccggcttcacgttgttctaatgattcgccacagcaaatgattggcttcatgccgttcttgaagatagcgtgtgcctttttgttaatgtcttcgtcagtttcgtggaaataaccgcgacgttctgaatgaccaataacaacgtaatcaacgcctaagtcagctaaggcagctggtgaagtttcaccagtaaatgccccagcatcttcaaaataagcattttcagcagcaatctttaaatcagaacccttggcagcttcaaccatttcctgtaagaaaagggctggggcagcaacgactgattcaacttttgatggatctggtaattgatccttaacagcattaacgaaagctaaagcttcgctagctgttttgttcattttccagttaccggcaataataggtgtacgcacgataaaccttcctttcggagaacagattatttttcagaaatagcagcaataccaggtaattccttaccttcaaggtattcaagtgaagcaccgccaccagtagaaatgtgggttaacttgtcgccaacgccaagttgcttaacagcggcagttgagtccccaccaccaacgatggtcgttgcgtctgataaggttcctaagaacttaccaatttcaagcgtacccttggcgtagttgctcatttcgaagacacccattggtccgttccaaacaacggtcttagcgtcgcgtaaaacatcttcgaattcttcgattgacttaggaccaatatctaaggccatgtagccatcaggaattgaaccttcaacaaccttgctaggaacatcgttatcaaacttttcagcaacgattgagtcgctaggtaagactaacttgtcgccagctttttcgatgattgacttagccaattcaatcttgtctttttcaacaagtgagttaccaatgcccatgcctttagcagcatagaacgtataagtcatcccaccaccgatgatgatcttgtcagctttgctgattaagtgatcgataacaccgatcttatcagaaaccttggcaccacctaagatagcaacgaatgggtgcttaggattgtcaaccgcgtcacctaagaacttgatttccttttccattaagaaaccagcggcaacttgatccatgtttgaagcaatcccaacgttagaagcatggctccggtgagcagtcccgaaagcatcgttgacgtagacatcaccaagtgaagcccagtacttgcctaattcaggatcgttaccagattcgcgcttaacttgttcgccgttaacaacgtcttcaaaacgagtgttttcaacaactaagacgtcaccgttgttcatgttgttgatggcagtttcaagttgttcgccttcagtaacagggacgaaggtaacaggcttgtttaataagtttgaaagacgttctgcaacaggacgtaagcttaagcccttcttgtcgtcttcgctcttaatccgacctaaatgtgagaataagatggctttgccatcatgttcaatcacgtatttgatcgttggtaaggcagcgacgatccggttgtcgtcaccaattttgccgtctttaattggaacattaaagtcgacacgaattaaaacttttttatctttaacatctaaatctgaaacgattaatttagccaatgttaaaatcctcctagaattcgtgactgctgaaattaaaaaaacggcaagaggagttttgcctccccccgccgtcaaaaccatatgcggttttaaagttcttaactatctaatcaaatattagagagtggcgaacttcaataaagtacgtaccatttggcaagtgaagccgtattcgttatcgtaccaagcaacagtcttaactaattggttgtcaccatcagaagtaacttctgtttgagtaggatcgaagattgaaccgaaagtagtaccgataacatcagatgaaacgatttcgtcatcgttgtaaccaaatgattcgttaccttcagtatgcttcttgattgcggcgttaacttcgtcagcagtaactttcttgtctaagatagcaactaattcagttaatgaaccatcaacaacaccaacacgttgtgcatggccttgtaatttaccgttcaattctgggataactaagccaagagccttagcagcaccagttgaatgaggaatagtgtttacaccggcagcacgggcagcacggaagttaccaccacgtacagggccgtcaagtaacatttgagttgaagtgtaagcatggatagtagtcatagtaccaaccttgataccgaattctttgttttcaaagaatgctaatggtgcaaggcagttagtagtacatgaaccagcagaaacgatacggtcatctgcagtcaagatgtcatcgttaacgttgtaaacgatggtcttcaagtctgagccagcaggagcagaaatcaagacacgctttgcaccagcgtccaagtgagcttgtgacttagcctttgaagtgtagaaaccagtacattcgagaacgaagtcaacaccgtcgttcttaacccaaggaatattttgtgcttgtggttcagcataaacacggtagttcttaccgttaacaacgattgaatcgtcggttgctgaaacgtcagcgttcaaagtaccatgagttgagtcatacttcaaaagatgagccaacaatgcaggtgaagttaaatcgttaatagcaacaacttcgatatcacttgacttttcaccaagttctaagatacgacggaatgctaaacgaccgatacgtccgaaaccattaataccaatttttacagacatactagaatttcctccttgtggaaataaaaatagttttattttaaaaagcaacttcactatagaagattacttttttaaaatcaagttagccgcaccctcatccgtgatcaaacacgtctgtttaggtgcaatgttcttcatatacgcggcaattgcggtggcttttgaagccccacccgcaatggcgagtataatctcccgatgggccagttctccgatttgcaatccaatccgcggaatccggtagaccacgttacccttcttatcaaagaagtaaccaaaggcttcaccaatcgcttcacgactgcgtaacaccttgatctgatcctcagacatattccggcgatgggccattgaaatagcttcaccgatactatgcacgaccacgttagcttgcccgataatcgccagcacctcttgaatacttggttctttgaggagtggttcatacgttcgttcactgacctgttctggtacaaacaacgagcggaacttaccgccagtatgttgtgccatttgtgacgcgatggtatttgcttgaatcgcaaccgattcaccaacaccaccacgcgccggaacaaataacaaatcacgtttatcacctaatttattagttaagtgacttgccacatgttccatggtatgcccacccataacagcaataatattacgcccttccggcaataattgctgtaatagctggttcacttcttcgcccatggtcccaataactttcaactgtcgatcggaatcaccagaaacgatgatgcaacgcttaatattaaagtattgcgccaactgtcgttctttctggcgaatgcccattagctcatccataaaatgacttagtcctactaacacgtcctgaccttgctgggtaacttgcatgcccgatttgtttgtcataatcaaatctagcttccgcaatgtatccgtttcggtccgtaacgtccgttcgctaacacctaacgtctgagctaatagccgacgtccaactggggccatccaattaatggttcttaatactaagtaacgacgactcagcatgtcaaccatatctggggcaattgcctcaatccattgaatatctgaatgcatggcatccaacctgctctctagtgggacgggtctggtccagctatgtcgaaaagcgacccaaagacttcaaaaaacaaagcacacaacgcgaattcactaagaaatcaatgttgcatacctctcttaccacaacatgaattataacaggttcataaggtggttgcaaatgaaaccccaattaaacttataaccgactggtccaaatggcgcgttaaattatcgttcggttctcaagtattgttttcgccttgatgacgacggaatattaagattttcgcgatatttcgccactgtccgccgagaaagttcgacattttccgcattaagaatctgaacaattttttggtctgaaagcggtttttctttattttcctgttcgatcaaggtcacaattcggtgttgaacactgtcggccgaaacgattttgccaccagtgggacgtttactgaccgctttggtaaagaaacgtttaagttcaaacataccgaagtccgtttgaatgtactttccattaatacttcgactgattgttgattcatgcacttttaactgttgggcaacatctcgtaacaatagtggccgtaaatccgtcgttttttccaagaagaagtctgcttgacgctcgataatggccgttcccactcgaaaaatggttgcctcgcgttgctgcaaactgttagcaatccagtcatactcacttttcttttctttcaaatattccgtaacttcctgatcatcatgctgccccatctgctgataataccgactgcggaatttaaccaccggttgagccatggatgcggttcgcaatgccagctggcctccctgattcgtcaccactaaatcgggaaagatgtacccggtcgtctcctgcccgattgccgcaccgggtacgggtgttagtgttcgcacataatcataaatacttgaaatgtccgcaagcgtcacctgatacttcttagccaacaagtcccattgtcgattaaccagctcgtcaaaactttcttctaagacaatataggctaagttcggtgcatggtcatcattttctgtctgcaacatcagcgcttcttgcaagctccgggccccaacacccggcggatcaagttgttgtaataaggtaattgcatccaacaactcaattggcgttgccttagtttcttgccgaacctgcctctcatcaatccgcaaataaccattcacgtcaacgtactcaattaaataaaggacaatctgacgcaaatgggtatcacgcatcgttaggtgaatctgatccaacaagtattcaaataacgaatgctgattagaggtcgacacacgctcaatgaaatccgccttagtggttacatttttggctgcgttcaaactggcgtgattattattccaatttgtatccacatcgatcaatgggttttctaatgctttttgcgttagaaaatctcttagttcttccacattaaactgcaacatctgaatggattgttgtagtcgctgggtcatcgctaacttctgtgattgccgctgttgctggcgaaatcctggtcccagtgccataaaaatacctccctgaataaatttttatgtaaaacccttgtgtttttatccattattcgctagaatataatatgttgtttaggcgcccgtggtgtaatggatagcacgtaagattccggttcttgagatgggggttcgattccctccgggcgcatcagtagctgagaaatgattctcagctttttttgtgcatttatttaagtgacaactactggactataccagtcacatctccatatagtaacttaatttaaaccaaacaacaagtaatatcctttcggggtcagtaatagtacctatacccgctcgtccaagtaaaaataatcaaaaagtaatcagttcaagtaaaccatataccagtgtagtcgtatagtagatttaataacagctaaacttacactattcaaataataattactacaattgttattatattatagaatcgttttaatcatggtaaatttcattcatgcatccgatactgattaattcgttgcgagcaacttgagtccagcaacaaggtcaagtcgtttaatatgtcggctcacgtgcgaatttccaacttctattagactcatcgttgtgggtcactatcagtaaattgattcacctactatcgcgataataaaattatgcgggtcgactacttttaaatcaccacattagtgctgaatatgcaagttcattactgcttaatcttgaatcattattataagagaacatcgttttcaagccaaggtagacgcaacacttaatccaaggcctactaactaaaatcgtcgaaaaaaaagagattgggttcacccaatctcaagccgtattatgatagaaacctaagtataccacgttaactgcataaacggaattctgtttttgaggtttttcttttgaccttcactgaccttagcggtaaactacatttatattagcaatcagctaatcaaataatgcaaccttaggaggctaacaaatcatgtatccagttcctacagttattgaacagtcatcacgtggcgaacgtgcttatgacatctattcacgactattaaaggaccgtatcattatgttatccggtcccattgaagataacatggcaaacgccattattgcccaactactcttcttggatgcccaagattcaggtaaggacatctatctctatatcaactcaccaggtggtgtcgttactgccggcttagcaatctacgatacgatgaacttcatcaaatctgatgttcaaaccatcgttatggggatggctgcttccatggccagcgtcttagcttcatctggtactaagggcaagcgttttgctttacctaactctgaaatcttgattcaccaaccatctggtggtgctcaaggtcaacaaacggaaattgaaattgttgcggaagaaatcttgaagactcgtaaaaagatcaaccagattttagctgacaactcgggacaatccgttgaaaagttgaaccatgatactgaacgtgataactacttaagcgcacaagaggctaaagactacggtttgatcgatgatattatggaaaacaacaaattaaaataagctaatatctttgactgggctaactagacgttggcccagtttttttgctcgttttcttgtcattcgttttgcaatagcccatactgcacataagcagggattactacccggacaatattacttgtccttgaacttaaaagtaaaaaggagtctctataatgacaaaagtctttattgctggtcagcttccagcccaagctaatacgttacttttacaaagtcagttagtcattgatacttataccggcgataacctgatcagtcacgcggaactcatccgtcgagtcgctgatgccgactttttgattaccccactctcaactcaagtagatcaagatgtcttagaccacgccccacaccttaaactgattgctaattttggtgctggcactaataacatcgatatcgcggcagcagctaagcgccagattccagtcacgaacacgccaaacgtttcggcggtcgcaaccgctgaatcaacggtcggtttgattatcagcctagcgcatcgtatcgtggaaggcgatcacttaatgcgaactagcggctttaacggttgggcgccactattctttctcggccacaacttacaaggcaagacactcggcatcttaggccttggccaaattggtcaagccgttgccaaacgattacacgcctttgacatgcccatcttatacagccaacaccaccgcctaccgattagccgtgaaacgcaacttggcgcaacctttgtctcccaggatgaacttttacagcgtgccgacatcgtcactttacacctgccgcttaccacacaaacaacccatctaatcgataacgctgcttttagcaaaatgaagtccacggcgctcctcatcaacgccgcacgggggccaattgtcgacgagcaagcacttgtgacggcgctgcaacaacatcaaattgctggcgctgcactcgacgtctacgaacatgaaccgcaagtcacacctggtttggccacgatgaacaacgtcattttgacacctcatcttggcaacgcaacggtcgaagctcgcgatggcatggctaccattgtcgcggagaatgtgattgcgatggcccaacatcagccaatcaagtacgtggttaacgacgtaacaccagcatagaccaatcagtgtagttgtcttgcgtgacaactcaagcactgtagaaccattcgtcgaaataaatagcggtccacttcgattcgtcaagacactctgacaagtcgaaatggaccgctattttgttttgatcaaggcaacgtatggacctggcgctcctactaaggtaacagctaaacgaccagttaccatgaacgtccctcaatcagttaattatttggcaatataagcatacttataattccactgtgtcccagcagtattatgaataataccctttacctttggattttgtaaataagagtataccgtctgatacaatggcgtaattccttggtccttcatgatcgtcttctcagcgttgatcatatcttgccaacgagcactagtatcattggcatcctggttttgggccttgttaaccaacgcattgtacgtgctgctgttatattttccgtaattataaccactattattagtcataatttgcaagtgcgagattgggtcgttgaagtcagcaccccaaccactgagataaaggtcaaaatcaccactttgagcacgacttgaagctacctttgatggaatgttggataagttgaccgtcaaaccatcgagattcttttctaatgctgatttcaagtattgtgaaatcggcttattaggttcgtcattagaagctaataactgaatggacaatttcttaattcccgtttccttaaggccttgtttccataacttttgtgccagtgctttgttatatgaagttgaattcttaaccgttgattcatctgcaaaatccttaccagttttagcgtctttaactaaatcctgaggaacaaacgtctttgagaccgttgatgcgtcaccaatcacattctttactaacgtcttgcgattgatcgacaatgaaattgcttgacgaatcttagcgttattgagcgcctttttgattgtcgcattactgtcttggaaattataaaccagaaacgcggtgatagaataagggtacgtggtatagtcagaactgctcttcatattcttaacttgttcactcgctaattgcgttagatcaagtttcttttcttggaacaagttcaatgttgtcgtagtactctcattgaccgtgtagttgatcttttgtaggtggacagctttcttatcccagtactgattattttttacaaactgccagccattattagttccagtccagccagtcaacttaaacggcccactgtagagcatgtactgagccttagtggcatatttgctaccccattttttgaccgctttctcactaattggtccaaacaacgggtaggtcattaacttcttaaaataagtaattggcttgtcaagagtcacaataaaagtatgttcgccttgcgccttgacgcccaatgtacttggtgactttttcccagcgacaatttcatccgcattcttcacccctgagaagaggtaggcatactgtgacttagttgctggggtgacggtccgtttccaagaatagacaaagtcttgcgcggttatcttcgaaccatcgctccacttcgcattgcgaatcgtaaaggtatacgtcttgccatcctttgaaaccttagtggacttagctaatcccggtgtaatgctaccattctttcctaaccggtataagctttcaaaaatattacccgtactgccatatcccgacatattggaaatatcgattgaatccaatgaactagggtacgacaagtttaaaacctgactacttgcatacttgccattaccagaagactggctattgtgcttcccacacgcagccagcaccgtcactaatactaggctcattaccactgctaacactgatcgcttcttcaaacttctcgcccctttacattcccattttgatgtgttgatctacttattcccatcggttgtaacaaaaaacgcctgttcagaatctcgtcagattccaagcaggcgtttcaaaattaacgatttgagctcaatcccgttatttttgatgcagagacgcttgtaattcaacgcaaatagccatgttgtttgattcacaacatgggcagcacatcatcatttgcattgttgatttttgcataattacgtctctccgatttcgataagatgtgttcagtataaatagttgcacttacttttgtcaagtgcttttcgagtatggcgaacgacaatcaatccatttcaacccaaaaaagccgctaacaccatctaaaatggttagcaagcttttcaacaaaactcatgcttaagccatccttatcgacaactaagcatctttttgtaattgttccgcaaattgattgattttacgcagccgatgattgattccagacttagaaataggcccgcccggaacaagggttcctagttccttgaggctaacttcacgatgttccaaccgggcaacagcgacttcttgtaattttggtggtaactgttgtaatcccaccgtagcatcgatcaataaaatattttcaatctgtttgctagaggcattggcaaccttatccatgttggcattctcacagttaaccaaccgattgaccgagttacgcatgtcccgcatgattcgaatatcttcaaacttaagcatggcattggtcgcaccaaccaacgacaagaagtcggcaattttttccgcttccttgatgtacgtaatgaaaccaccacgccgatcagtcgttcgtgaattcaagccatactgattcatcatctcggagatcatatgattatgttcctcatacagtgagtaaatttccaaatgataccgggaagtttcaggattattaaccgaaccgcccgctaaaaaggcgccacgcaaataagaacgcaccgcagcatcatccgttaacacttcagttggtgccacttcaacgatttgataatcctttaaaatacccaaatcagcgagtaccatgtccgtaccggtcttcaatcgtacgatgtacaaattattcttatttaatttcattttgcgccgaacaatcaattcactatcgacgtcataaaattgtttgagtagccggtaaatacgccgcgcgatggccggattttccgtctgaatattcaaaatgaagtgatgattagcaatgctgatcgccccattcattcgaatcaaagccattaattcagccttagcattctcgcgatggacagcgaggttagtcaattctttcttaacgtcactggcgtatgacatgccacgacccccttatctgaaaacgtcggaatgaccgactagattcattaattcagcgacaacttggtcgccatcatgaaaggccccattatcacggagtttcaagaagttcgatgagattacgcgacagttttgttcacgtaacccccggaagtcatgactcacttgctttgaaacttcgttaaacttatgaaaatccatgtaatcttctggcactttttcggtgttaactaacaccgtattaataaagttctgccccaaatggcggtttaagacccgtacatgatcagcatcggagaaattatccgtttcacctttttgagtcataatattacaaatataaaccacttctgcatcagactcacagacggcccgaccaatatttccaatcgttaggttcggtagaatactggtaaacaaactaccgggccccaaaacaatctgatctgccgccataatcgcatcaataactggttgaactgcttgtggttccttaccattcttgtcagtgacccaaacgcgttccaatgacttatgggccgcggtaatttcggcttcacctactaactcagtaccgtcactaaacttaccatgtagcgtgagtgcctcgttggctgccgggtaaacatgaccatctacttgcatcatatttgataattcctgcaccgcgtcaaacaccccggatttcatttccgttagtgccgcaataattaaattaccaatcgcatgacctgcaaaaaattgatcatcaccctggaaacgatactgaaaaatatctttatacaaatccggccaactcgacaacgccaccattacattacgaatatcaccaggtggaaccacgttaacgtaattgcgaataatgccggatgacccaccatcatcagccaccgtcaccactgcggtaatatcgactgcctgcttacgcaagccgttcagaacaaccggcaaaccggttcctccaccaatcaccacaattttaggccgctgggtcttaaatgtgtattttctcatgagcgattaacagtttcctttcgtttctcaatatcacgatgactgatgtgcaccttgtagtgcttagccagcgcttcaccgatacgttgcgtcaaggcaacggaccggtgttgaccgcccgtacagccaatcgcaatcgtcaaactactcttgccctcggcttcatagccgggcataatgctttccagcatactcaagaactgctggtagaaagcttccgtagctggttgctgcataacgtaatccgccacaggtttatctagtcccgtcagcttctttaattcaggaatgtagtatggattaggcaagaagcgcacatccataacgatatctgcatcaatcgggagtccgtatttaaaaccgaatgatagcatttcaatatgaaaagtctcatcctgatccgtttcgaatttatcaaaaatcgattcgcgtaattcacgtggtgtcaacgtcgacgtatcaatgacgtatgaagcccgatctttcaatggcgccaataattctcgttctttgcgcacgccatccatgacgcgaccttccatggctaatggatgggaacgccgcgtctctttataacgtgacactaattcttcgttggaagcatctaaaaacagaatccgggtcgacacaaagtccgtgttgtctaagttagccaacatatccataatttcgtcgtaaaaagcccgcgagcgtaaatcaatcactaacgctactttctttattttacccgactcctcaactaattctgagaacttcggtaataacgctggtggcatattgtcaatgcaaaaatagcccaggtcttcaaagctttgaaccgcaaccgtcttaccggcaccgctcatcccagaaataattactagttgtaatgattctgccatgctgtattggccccctctagtccatattgttggtagtataacacaccgggtgtgtcatttctactgacgtgccacttcgacccgccatttgattccaaacagtattacattaacgcgcaaaaaaagaccccttaacaacaccctgacaccaccaatagtgagcgccaagtatcgctaacgagtcaatactgccaagctagttacgccgagcaaaagcaatcaagattgcgttgatgccaaaaactgcaaagtagaaactaaccagtacgttgaaactaatcacagcaatcattggattgattactaataagattcccaatgccaaactaataatatccaagattaaagatagaacaaaatacccggttccaaagacgcgtagatgtgagactacggtcagccgttcaatcgaatcgatcaagaaccaaaaggcaaagacgtaaccgagtaccagtaccccagtcggtgcgtggaataaaaataataaccccactaaaatatcaataatcgcaaacacaagggcaaagtttgcccgcaaccctgtttcacggcgtagttttgtgtacccaccgattgtggtgaccccgctaataattgcggcgatggcaaataaaaagactaaacttaaaagtgctgcttgtggttgcttgatgacaaagtaagcggcgatcaagaaaacgatccccgtcatgaattcagtccaatcaaacccccagcgatgatcattaaacatacatcaacatctcccatatccgatattaattccatcttaccagttaatgtaagagtttccaatttttctgatagactttatgttagcttaatgctttttcaaaatgtcaatagcattaaaaatggcctctaaatgccgagtctccgccacttagaggtcatctttaaaaataatatcaatggtcaaattgataagcattaattaatcagtggtttcagattgataggctgacaattgcgtttgtgcccgttgcaattcttgtctaatctgatcaaaaccagtaccacctagcgaatgccgccgttccaccgcaacttttgcgttcaaatcatggtagacatcttcttggatcagcggtgagattgactgatattctttgagtggaatatcctgcaacggccgctgttttttcaagccatccaagacgagcttccccacaatggcatgggcctcccgaaatgggattcctttgtttgcaaggtaatcggctagttcggtcgcatttgagaaatcgttagtcgtggcatcagccatccgatcttcattaacggtcagcgttgccaacatgccggtgaagacgtggagactcgttaacacggtcgtgaccgtatcaaacgccccttctttgtcttcttgcagatccttattgtaagcgagcggaatccctttcatgacagttagcaatcccatcaagttgccgtaaacccggccggacttgccccgaattaattcggccatgtcagggttcttcttttgcggcataatcgaactacccgttgaaaactgatcgctcaaactgatgtacttgaattcataactgctccagctgacaatttcttcacaaaaccgtgagagatgcatcatcaggatcgaagcattgctgagaaactcaagcacgaagtcccggtcagaaacggcatccaaactattatgatagacttcactgaatcctaatagtttcgcactatattcccggtcgattggaaaagtcgttccagcaagtgcagcggctcccaatggcgaaatatcggtatgcttcaggttaaactcgaagcgttccatgtcccgcttgaacatttggtaataagctaacaggtagtgcgcgtacgagatgggttgggcgtgttgcaaatgcgtgtaccccggcatgaccgtctccacgttctcactcgctttatcgaccaataccgtttccagttcatgtagccggtccaatattagtggtaattgatgcttcaagtacaagtggaaatccgtggcaacttggtcattccgcgaccgggccgtgtgcaactttccagcgactggcccaatctcttcggtcaataatgactcaatattcatatgaatgtcttcgttgaccgttgaaaattccaacttaccttgtttttgacgctcagccaaggtttccaaaccagcaacaatttgatcaacatcagcggcaggcaaaataccagttttcttcaacattttaacgtgtgccagtgaaccagcaatatcttctgcggcaagcaactggtcaaagctaattgatgccccaaagtcatcaacatacttagcacccgtttcggtaaaccggccaccccatagcttcttggtactcattaggcgtgtgccttatcagtcttagcttcggcctgagccttcgcttggacttgggcattaacttgcgttggtaagccccatagcttaatgaaaccaactgccgcttgttggtcaaatgaatccgctgatgtataggttgccaagttcgtatcatatagtgagttgggtgacttccgcccctcagtaataacgttacccttgaagagttgtacccgaactaccccattgacgacttgctgagtttgctttaagaaggcaaccatcgcttccatcaatggtgagaaccaaagaccgttgtagatcgtatccgcaagcttttgttcaatgattggcttgaagtgagctaactcacgctcaaacgtcaaatcttccaaatctttatgtgctttgagcaataccgttgcagctggtgcttcgtaaacttcccgtgacttgataccgaccaaccggttttcaatatggtcgatccgaccaattccatgttcaccagcaatctgatccaacttgatgattaaatcagctaggttaagtgattcaccatctaaagcaactggcaccccagcttcaaaagtgatttccaaagtcgttggcgtatccggcgtatcagctaaggccttcgtccggtcaaacgcatcggcaggcgcgccctgccatggatcttctagaatgccacattcattggcccggccccataagttttcgtcaatcgagtaaggactgtccaaattgattggtacgggaatattgtgttccttagcgtaatcgatttcttcttcccgtgaccagtgccaatcacgtacaggcgcttcgatcttgatatccggtgcaagagcatggatagcaacctcaaaccgaacctgatcattacccttcccagtacaaccatgggcaattgcaacagcgtgctcttgcttggctaatgtgactaacttcttagcaattaaaggacgtgaaagtgctgagaccagcgggtattcaccttcatacaaggtatgaccttgtaaagcaattaacgcatattcttcagcaaattcttgcttagcatcaatcatatatgatgaaacagcccctaattttagggccttttctttgattgcatccatgtccttgccttcaccaacatcaattccgcaggccacaacatcatagcccttatccttcaaccaactaattgcgaccgacgtatctaaaccaccagaataagcgagaataattttatcattttgtttgaccattgatttgtacctccgaaatttttatctttgcttttatcaatgacagtatcgtaccacccaatttaactttattcaataatattttaaatatattcatcatttgtgcaatattcactaaaatgtagaatttttatgcagatattcaccgaaatcagtatattttttgttatttttgaaacactaccttaatctaatcttagattgttttcccacgattcaggaccgctaagctcgcacaatgtcagtaaacagcaaaaagagcctagcttttcgttatgaaaagctaggctctttttaattggtggccggcaccaccattactttttatattttggtctattcaacgactttgcgtacaaatggatccgatgaaattccttgcgataaaatcaacttggcccattccttagctgagaataaagaatgatccttgtaattcccacagctatcgatggtcgtcccttgtacgtcttcccacttagctgggccagcaatgaattctaatgaggacttcaatgccttagcaacttcaacggtgtcatgttcaccccaagtaatcaaatgaaaaccagtccgacaaccaaatggtgagcagtcaatcacgccatccatccgatcacgtaataatccagccaacatatgttcaatcgtgtgtaagcccgccgtatcaatagcggtcttgttaggttgaactaaccgcaaatcaaaattagtgatggcatcacccttaggcccattttccaccgtaattttacgaacgtaaggtgctaaaaccttggtatgatctaatgtaaaactttctactttagccatgtacaaacaactcctctaaattaaaattacattacaaactcaagtgtagcacattgcccgttatttagcaggtgcagttgcttcacgtgctcgatcccgttctagaacgggcttcaagtattggccagtataactttcagccacttcagcgacctgttctggtgtcccagtagcaacgattgttccgccgccgtcaccgccttctgggcccaagtcaatcaaataatccgccgacttcacaacatccaaattatgctcgatgattaacacggtattacccgcatccaccaaccgatccaagacaccaatcaagcgccgaatatcttcactgtgcaacccagtcgttggttcgtccaagatgtagaaattcttccccgactgttgtttgtgcaattcggaagctaacttcatccgttgggcttctccacctgataaagtcgtggcgggttggcctaacttaacatagcccaaaccaacgtcgaccaaggtctgtagtttccgtcgaatctttggaattggttcaaagaacttaacagcttctgaagcggtcatttgaagaacatcggcaatatttttgcctttgtattcaacttccaacgtttcagaattgtattgcttaccatgacacacttcacaaggtacaaagacatcgggcaagaaattcatttcaatttttagaatcccgtcaccgtgacaagcctcacaacgaccacccttagtattaaaactaaagcggcccttcttgtaaccacgtaatttagcttcattcgtttgtgcaaataaatcacgaatattgtcaaagacaccagtatatgtggccggattactgcgtggtgttcggccgattggactttggtcaatattaactaaccgttcaatattcttaataccactgacactcttatacttaccaggcttttcagaattacgattcaacttctgtgccaatacgcgtttcaaaacatcgttaaccaaggtcgacttaccagaaccggaaacccccgttaccacgacaaattcgcctagtggaaaatcaacgtcaatttgcttgaggttgttttcggccgcaccagtgatacgaatcttcttaccattacccggacgccgagtttcaggtagtgggataaaccgtttgcccgatagatattggccggtcagtgacttccgcgagcgagccacttgcttgggcgttccggccgccatgacctcaccaccgttttcaccggcacccgggccgatatccacgatatagtcagcggcccgcatcgtgtcttcatcatgttcgaccacgatcaacgtattccccagatcgcgcatcttcttaagtgaaccaatcaagcggtcgttatcccgctgatgcaatccaattgatggttcatccaagatatagagcacgccggacaagttcgatccgatctgtgttgctaaccggattcgctgggcttccccaccagacagcgtccgtgcagaacggctgagcgttaagtacgccagtcccacattttgcaagaatgataaccggtcgcggatttccttcaagattggtttagcaatcacgagactttgttctgataagctcaactcgttaaagaaatcgagttccttaccaatggctaagtcagagaccatcccgatatgttcgccaccaactttgacagacagggccttgcgatttaagcggaacccatgacaagtctgacaagtgagttccgtcatatactttcgcatcacatcgcgggtgaaatcactattcgtttcgtggtagcggcggtcaacattgttgataacgccctcaaacacagcgtcaacatcgcgaacaccaccaaagtcgttctggtagtggaaatggaacgtctttccgttagacccatacaaaaccgtttgttgatcagcttttgataagtcttcatacggcacatccatcggaatttctaactgttcacaagcttgcttcaacatttcaggataatactgtgaactgattggattccaaggcgctaacgcaccttcagccaatgtcagcgacttatcaggtacgacaaggtcctcatcgacttctagcttgattccgagaccttcacagtctggacaagctccctgaggcgcgttaaacgagaataatcgtggttcaagttctcccacagtaaacccacagataggacaagcataatgttctgagaacataatgggttcgccaccgatcacatccgcaatcgcatagcccccacttaatcgcaacgccgcttcaaaagaatcaaataaccgagaacggtcacctgacttcacaacgatccgatcaatgacgatttcaatcgtgtgttgttgattcttgttcagttcaaaagtttcactgatatcatgaatatcaccatcaacacggacccgcacgaaaccttcacgcttgatcttttcaaagatctttttgtgctcgccctttttctggcggacaattggtgataaaatctgcaacttcgttcgttccggtaatttctgaatccgatcaaccatctgttcaacagtttgactcgcaatcggtgtcccatcgttcgggcaaatcggttcaccgactcgggcccacagtaaccgtaaataatcattgatttctgtaacggttccgaccgttgagcgcgggtttttggatgttgttttctgatcgatcgaaatagccggactaagcccatcaattgaatcaacgtctggtttttgcatctgtcctaagaattgacgcgcgtacgctgacaaactttccacgtagcgacgttgtccttccgcgtacaaggtatcgaacgctaacgaactcttacctgagccagacagccccgtaatcacgactaatttgtcgcgcgggatggtaacgtcgatatcttttaaattatgggctcgcgcaccgtgaatgacaatcttatcatttgccaaaaaaaggcctcctcaatctcaagccagcaacctgctagctaatttgtgctttcaattccatgaccgtatcacgcagcgttgcggcttgttcaaagtcgagcttcttagcggcggtcttcatctgttcttccaacttactaatcatatctaattgttgttcacgagtcatatcatcaaagtcggtttctaagaagtcatccttcttacccgcgtcttcagtggtcttcgtcgaagcaattagctctggaatggcctttttaatcgtatgtggcgtgatgtgatgatcttcattgtacttcatctgtactgctcgacgacgtgcagtctcatccatcgcggcctgcatcgaatcagtcgtggtgtcagcgtacataatcactgaaccgtgctcattacgagccgcccgaccaatcgtttggatcaacgaacgctcgttacgaaggaaaccttccttatccgcatccaaaatcgcaactagtgaaacttcgggaacgtcaattccttcccgcaacaagttgatcccgaccaacacatcgaacttgcccagacgcaggtcgcggatgatctgcgttcgttccaacgtcttaatatcactgtgcaagtaccgtaccttgatgcctaaatccttaaagtagtcggtcaaatcttccgccatcttcttagttaacgtggtgataaagacccgttcgttgacctcaatgcgcttattgatttcacccactaagtcatcgatctgacccataatcggtcgaacctcaatcgtaggatccaataaaccagttggtcgaataatttgctggacgacgtgcttggtccgatccatttcgtaagggcccggcgttgcggacatataaaccacttgattaatatgctgttcaacttcttcaagtttcaatggccggttgtccaacgcacttggcaaacggaagccataatcgactagcatttgtttacgtgctcggtccccattatacattccccgaacttggggcatcgtcacgtgtgactcatcgaccacgagcaaaaagtccttcgggaagaagtccagtaacgtatacggtggttcgccaggtttacggccatccataaaacgtgaatagttctcgataccactagtgtagcccatttctttgagcatttcgacatcataggtcgtccgctgcttgagtcgttgcgcctctaacaatttgccatcggctgtcaattctttcaggcggccatccaactcatcttcaatgcccttgatggcgtgttccataatcgcatcattcgtcataaagtgggtcgctgggaagatcgcaacatgttcacgatcagccacaatttcaccggttaaggcgtcaatctcacggattcgatcaatctcatcgccaaagaattcaacgcgcaatgcgtggtcatcccgtgaagccggaaagatttctacgacatcaccatggacccgaaaacgcccccgctggaaatcaatatcgttacgatcaaattgaatatcaacaagtttacgcaacagatcattgcggtcgatctccatgccgactcgcagtgagactacgtgatcttggtactcgtgaggatcccctaaaccgaaaatactggagaccgatgccacgacgatcacatcgttgcgttccaataatgagctggtcgcagagtgccgtaacttatcgatttcatcgttgattgccgagtccttctcgatataggtatcactcgaaggcacgtacgcttccggctgataataatcgtaataactcacaaaatattcaacggcattgttcgggaaaaacttcttaaactccccgtataattgacccgctaacgtcttgttatgtgacaagattaacgttggcttattcacctttgcaatcacgttcgaaattgtaaaggtcttcccggtcccggtcgcccccaacaagatctgctctttttctcccgattcaatgccagcggttaattgctggatcgcttggggttgatcgcccgttggttggtaatctgaaactaagtcaaaatgattattatctacccgatcaatcaaacgtagtcctccttttaaacggtcacccgttcatatcatctattgataactaaatcttactgtcgcaccataaaaaataggcaagcccgcgcttccctatcacattcaaatcgcatttaattttagcacatcgaacatactttcgccattaatcggattgcggcccggccgttaaaatctgggtcgtcagcgcctgtaattgatcctgatgcgtgaacggttccgctaacatctctggtagcactgcttttaagaaatattgaacactagtcatctttttaaacgcgacaattgtttttaaactttcttgataaatatccctaaaaactggttccggattacccttttgaatttcaccaaacgactcatacaataggtcaattttatcggctaccgacaatatctggccttctagcgtttcatccttaccttctgatagacgccgtgaataagctgcctgaaactcagctggaatctcattttgcacaaaattttgtgataatttatgctcaacatccgccagcatcgtccgtagcgtcggcgttgcgtacttgacaggcgtcttaatatccccgataaaccgctcattatagtcgtgattcagcgccttctcatagagggctcgccaatcaacaatttgtccggcattttcttccacatcacctaaaaattgggcgacttcagcaaccttaaatgaatgcgccgcaactgaatgattctgatacttaaaaaaacccggggcccgttgaatcgtttctaaattacttaagctctgaaaatattgatgcattcccattgcagcccaccatccttcaatctaatttggcctaagtgtaacaaaagcgccccggggacgcaaacccggagcgctttcgctgattagcttaactgttatgcaatgttaaacttgctgatgtgaatgaacctggttcggtaatcgtaacataaatgccattaaataagaaacaatcaagaatccggccaccaccagatatggatagtgataattcatatctagtaacatccccgatatgattgggccaacgatattgccaacactcgttaaggacatgttaagcccattgattagcccctggttggcctcacttgctttcgttaatagggtcgtaatagcgggccgcaaaagatcgaatgccgaaaaaataacgagcgttgcaaccatgacagcaactttcgaatgagcctgcgtaatccagatagtgcagagcgccgcagctgcaaagcacacccgaatgacccgccgttcgccccaacgctggacaaaggtatcaaatagtgccacctgtaggaagagcgaaatcaaaccatttaaagtcaagaccaacgcaatgttgctcagactaaagtgaaagacttcattcacgtaaatactataaatgctctcaaacccctgtaagccaaaggaagacactaaaatcatcgtaaataatataataatcgggacggtccaaaatgcccgcgtcatcggatgattggtcgtcgttgtcgtggccgtaattgcttcgcgatcaggatcaatctgacgatccgcaggcaacagaatgacgagcacaatggcactgagtaatcccaatgcaccagcaacccagaacggcgtcttataactaatgccagccaataccccaccgataccgggtcctaaaatcaagccaccactaaaggccgccgataaccagccaattactttagctcgctgtcgtttggtcgtaatatcggatgctaacgccatcgccgtcggaacgaccatcgctgctgataagccaccaacaatccgggaaatattaaagacccacagctggttggttagcgcaaatagtacttccgagaccatatataagactagccctaccgttaatacgggcttgcgaccaactttgtctgaaacccggccaataatgggagaggccacaaattgtgccaatgcgaataacgcattcattattcccatatcggtagccgttaaatgcagttcatttttaataaacggcatgaccggaataactaaactaatccctaaacaaactaaaaactcactaaaaactaaaattaaaattgcgcgtcgtgtttgtcgatccatgcgacctcacctcttcaatcaattgttaaatttacaccgctttccatcatatcagggacccggattgaaagctagcagaaagtttgacaccatttacaacccttttagtcggtaaaatatcggccaatcagatacaataagcataactaaattctaaggaggccctactatggatcaagctttaactggtttcaccaatattcaacacttagaccccgaaatcatcgttgacctgcgttatgccaccactaataactttactcatcaagtgatttacgactttaccacggccattgttcgcactggcacggcccacaaactcgccaaggcaagcgccctggttaaacaacaaggttatcgactcaaagtctgggatgcttatcggcccgtcagcgcccagcgccgtttatttgaagtgtatcctgatccagaatttgttgcccagcctaatcctaatttcagccaccaaaaaggcgtcaccttagatttgaccctggcccatcctgatggtagtgagttaacaatgccaactgccttcgatgacttcacggcagctgctcaccgtgacgctcctcgaaccgcacttcaagaaaaaaattatcagctgctggacaccgccatgaccgccgcgggctttgtcggctacgttaacgaatggtgggactaccgcgacaccgaaatggacgcttaccaacccctagccgctgatcccaacgactatgcttgaccaatcactttcaaataatataaaggtggccgccaaacagtcaggttatgaaacccactgtttggcggtcaccttatttggctcattatttttatggattcaccagcacttattattaaaacatgctagttagttggattgttgcccgtcagcatatgcgcgtcctcgtctgacttccaggaaaccactcgagtggcagatgaacggccgcttaacccaagctaatctgtcgctgaaccatctactccgttagacttggaacaaacgttaacatagcacattcgttttgaataccatcccagcgattggcagcaatacctgaagaacggtatcggacacactccccaaacaagtttacgctaatctgaacttattccagcgggtctaagctggctgttcttgattttaacaaccagcaccttctgaacataattagtgcaaaaacttaattattccgacgatagccatgttcctgatctactgcagcctgcgccactaaattcaagtaattaaacggttcatcaaagttgggtgagaatagcatatccatgaaggctaattcatcaatcgtattaccattatgaatcactacggacaacgtatttgctgattgtgaaacttcatgagcactcattagttgaccacccaaaaccttccgcgtttgttgatcataaaccaactcaatcatgactttcgccgtggtaggcataaagtccggccgataattgccttcataaaaagctgcttgggcatcgaagttagctgctttggccgccgttaaggtcagacctgcacaagccacggtctgatcaaaaatcaacatcccagtcgtcgcttgcgtaccaattgcacctaagcgtttatcaaagatattaattcctgccagtgcaccttgccgaattgcatgtgagactaatggcatataggcgtgttccttcgtaggattaaagttaacttccgtcacatcgccagccgcaaatatatccgggttggaggttcccatataacggtccgttacaatggccccctgcttcgttcggttgacctgtcccgccaataactctgattgtggaatcacccccggacaaataacagccatatcaaatatttcttcactatcagcggttgcaactcgtagtcgattatcagccgtatcactaaaagccgtcacttgtgcattggttctaacttggatgcctttcgtcgttaacaagtcttcgatcttctcagaaatttgtggatcaagatactcattaattaagtgggggccccgttgaaacaacgtcacagtgtgtccagacttcacgtacccctcagcaagttccacccccgaatagccaccaccaacgattgcaatatggtgtgcatgtttagctgcttcgtagagttgctgggcctgttcacatgttttgcaaagcatgaccttaggattctctacgcccggaatagccgggattgcagtgattgaacccgtcgccatgactaacttatcatagtgatccgtttgtaattcttttgtctgtaaattttgagccaaaattgtatgcttatcagcattcacattgatcacatcatactgcatccgcatctgcacaccttgttcactaaattcactaggattagcgtacaacgcttgatccaaattatggatggtaccccctaagtgtagataagtcccacaagacatatatgaaatatccgcgtgccgttcatagacggtaatttcagtgcccggataatatttcaagatttgtttcatggcggcaatccccgcatgtgtacagccaataatggcaactttcattgtttcgaccacagctttcattaaaagttaaaatttaacttggattaagttaaacatttatttaagttgacgtatacttagagtatacagcgattcggttgatattaaaacgattcaatgattttaaacttattataaaaggcgatggtacttatggaaccaatttaccgctattttgtacaacctcaacttaacttactcaacaatacagtttacggatacgaactactaatcaaacaactaaccccagacggctggcgtctgcctgaatcctttgccgcaattagttcacaagttacctctgatctgctcattgcaacgactaaaattcttggactaaaagttcgttattgtgcagtcaatatcagtcgcgaacaattgatggatacaacggttgcgaaggccattattcaaagtcaggttcagctctatcctgctaaattagtcgttgagctaactgaggaacgtagtcctaaggattatccagataccatgttaatcccacacttacgggggttcatcgaacatggtatgcaaatttcacttgatgatgttggtaccggaattaacgatttcaagagtatccaagaaattttgccattagcttctgaattaaaatttgcgttgcaaaacttccgcagtgatatcaaagatcctaagattcagcaaaagctccatttttggcgggccatcagtagtgaatacggattgcgtttaatcttagaggggattgaagacgccgaagatgatcgcttgagtagtcacttcgatattaatcttcgacaaggttattactatggcaaaccgcaattattacgcctacccggtgaccccgtcaactttgaatatccgacaatgaattaatttctaatgtgaacaacaactaaataacgccttacgaaattaacttgaaatttcgtaaggcgttatttatcacttagcatggctagtcagctgggccgtacaacttctgactaaataaccaatttattctttaataaacgcttgaatggcatcttcaaatttcgctaacttatcattagcttcttctaacgtactacctagcgttccaatgtagaacttgatctttggttccgtaccagatggccgaatggcgatccaagtgccatcatttaaatgatacttcaagacattcgcctttggcaaagcaattggtgccgtgtggccatcagcaaagctttccgtttgactctggaagtcttcagtcccagtgacatcgtagccggcaaaggcagttggtgcttcgcttcggaacttagtcatcagagccgcaatcttatcgctgccgccaacgccatcaaattcttcggacgtggtttgttcgcggaagtaaccgtattccttaaacaagtcttgtaatccatcataaaggttcttaccttgttgcttataataagccgctacttcggctaaaagcactgtggtttgaatcgcatccttgtcatgaacaaatggtttgattaagtaaccgtaactttcttcaaaaccaaacatataggtatgttcgccagtggcttcaaaatgttcgatttgttcagcaatatacttgaaaccggtcaagacattgatcatcgtgacaccatatgaagccgctactttagtagcaaattcacttgaaacaattgacttaactgcggccgcattggtcggtaacgtcccggcatccttgtttgcttgcaagatgtagtgtaacaagacagcggcaatttgattacccgtcaacagaacatactcaccattaggttgacgaacagctgtccctaaccggtcagcatcaggatcaaccgcaatcaagacatccgcaccttcttttttacccaaatcaatggccatcttaaaggcttcaggaaattcaggattagggaatttaaccgtcgagaattcagggtcagccacagcttgttccttaacaacactgaagtttttaaacccggcattcttcaaagccttttcgccaagcatccggccagtcccatgtaatggtgtgaagactaacttcatgtccttaccgacttcatccactagtttttgattgatcgtcacttctttgaccttagctaagtagtcctgatcgacatcatccccaataatggtttccgtcttatcagctaataattgttgttcatcagcaacggcaatcgcaaagacatcgtcaactttacgaatatatgatgtgataagatcagattccttaggtggcatttgaccaccatcttcgccataaatcttgtagccattatattgcttcggattatggctcgccgtaatcatgatccctgcgtaagtatgcagatgccgaacggtaaatgaaagttctggggttggccgcaagctttcaaaaacgtatgacttgataccatgttggcccaatactcgcgcagattcatgcgcaaaatcttctgaatgatggcgggaatcaaaactgattgctaccccgcgttccttaacctcagcaggcaaggtatccatgaagcgtgctaacccttccgttgcttgacgaaccgtataaatattcatccggttgataccaggtccaagtccccccccgcatccccgcggttccgaattccattggttcataaaaggcgtcttctaaggcggcgtcatcgccagccatgcccgtcaattcttgttttaaactagtttcaagtgtcgcttggtttttccaggtattataagtatcctgccaactcacaaaaaccatctccaattccgatatttgttagtgcttacaaaaatagtatacaacattgacacactttacaaagtaaaatttactaagaaaatccattaattaatgcattttaaatgcgtagtgggcccgcatcagtgcgaatacccataaattctgaagtgctagttagttcagtcactatcaaaacttgctataataaatcttataaggaggccatcatgactttttattcatacaactacttagtccatcaaaataacaatcatactcttgtccaactcgcagccatcggcatcattatattaataatcgccatactcagctggttatggtaccgccataaaacagacctaaaataccgcgacttattcattatcatggttttattattattgctgctcgtcggcattcaatttaatgaatggcagacaatcaaaaatagtttcaaccaaaaatcacaagtgacacaaattatgcagcgtgtcgccaaagaaaaaggggttcgtaaaaccgcggtctggtctaatacaagttctgtcagcagtgggatgctcattaaagtccatgaccatatctataacgtgacgatcaatacggatggaaacagttataccctgactaaagccacaccgattcaatcaacaatcaattatgttaaggaggggcaataaatgttttcatactgggatgtgacgatcaaactggccctcgggctattgaccatcattctacaaatcaatctatctggtaaaagtaaccttgcgccaatcagcgccctcgaccaagttcaaaactacgttctcggtgcaatcgttgggggcatgatttatagtaccagcgttactgttttacaatacattttagtgcttctcatctggacactgctagtgctggtcctgcgattcctaacacatcacaatcgctacgtgaaacgtttgattgatggacagccacagctattgattaaaaatgggcaattactcgtcagcacggccctcaaaaatgggatgagtgctaacgatctgatgtttcgcttgcgtacggaaggtatcacggatattcgctacgtcaaacgggccgtacttgaacaaaacggccaactgacgattacccaagtgggcgacgacgccgtcaagtatccaataatcgtcgatggtcaggtcaacctcgatgcgcttgaaactagtaatcatgatgaagcctggttactgacccaattgcaggcccagcactatactgtcagtgatatttacctggcaacgtatactaacaagcaattgcttctatttccctatcaacactaattcgcgaacctttggtcatcgtcaaacaatgactaacgctatatttaccaataaaaaatgcgtggctgatctcaattaaatcagctacgcattttttaattttatttaattgttaactttgtcgcctaaagcagtgatataagtgtaaacgccttgaccggcagttccgccttcaccaaccgccgtcgcaacttggcgtaaatctttcttacgaacatcaccgactgcaaaaataccagggaccttggtttccatgtggtcattagtttcgatccagccgttttcgtcagtaatcccaagattactgaatggcttcgtaattgggttaataccaacatagataaagacaccatcgaccgcaatctcactgtcttcaccagtcttattattattaaccttaactcccgtgaccttcttatcatcaccgatgatttccgtcacgttgctattccaaacaaattccatctttggattagcaaaagcccgatcttgtaagatttgttgtgcccgcaattggtcacgacgatgaataaccgtcaccttatcagcaagctgtgtcaggtaagtgccttcctcaatcgctgagtcaccgccaccaacgacaactacatgcttgttacggaaaaacgctccatcacaaactgcgcagtatgagacaccgcggccaccatacgtatcctcgccagtaacacccagcttacgatattcagaaccagtcccaatgacaagggccttagtctcaaacgtatcgctatccgtcgtcacgattttaacatcgccgcgatcttcaacggattcgacgctaccatacgcgtattcagcaccaaactgggtcgctgattcatacatgtctttagccaaatccggccccaaaacagatttgaagcccggataattttcaattgcggcggtattattcatttgcccaccatagattccgcgatctaatagtagcactgatagattggctcgtgaagcatagagggcggctgtcatgccggcaggccccgcaccaataataatcacgtcgtaactctttgccatttctaaagaccccttccacttaaattcctatgacgcttaatatacccccaaaatttacatttgtcgactatcttgtttgtacacaactgaagtcaattatagcttttaaccatatattgactaaaaaccgagatttaaataaataaaattatgccagttcacttgaattcaacccatggtaagacttacttcttattgtaaatccttgtcattttgcttggcccaatcgccataggccgtaattcgtgggtgattgcggcctgcctggcgttcttgttcaatcgcttgttgggcgacgaggttcagataattgaagggttcatcaaaattaggtgagaataacatatccacaaatgctagatcatcgatggtgtttccattttgaatcgcgattgataacgcattagcagactgtgccacttcatgcgcacttaagaactgagcaccgagaattttacgattttccggattataaattaattcaatcatcagtttcgccgtacttggcatgtaagctggtcgccagttgccctcataagtcacccgttcagctggaatatgattcaatttcgccattgccagtgttaaccccgtggttgccagcgtgtgatcgaagagttgcatggccgatgtcgcttgagtccccatatatcgttgctggttaccaaaaacattggcccccgctaacgcaccctgccgaaccgcattggttgctaatggcgtataagccgaacgtccagttggattgaagttaacgacacaagaatcaccagcagcgtaaatatctgggtcagaggtctgaacgtaatcattgatgataatggcaccgtgcttatccatctcaacttgaccgcgtaacagttccgtattgggaacaaacccagttccgacaattgctaaatcagcattaaaatcgccttgattggtttcaatgacaagttcaccatcatcattaccagtaaaggcagttacttggtgattcaatagcacgttcacgccatgatcttttaatagctgaactgcttggtctgaaatttctttactaatgtaattattcaaaatttgatcatgcgattggaataacgttacttcatgatgtgtattcgcataactttcagataattcggttccaatataacccgccccaatgattgcgatccgctgattgtcttgggctgtttggtaaatttcctgtgcttggctgtaggtcttgcataataggaccttagactcatcgattccaaaaatcggcgggaccgcaacatttgaaccagtcgtcataatcaatttatcataagtatcgccaaacacttttccagtagtcatgtcaaccacttgtaaggtcttcgactgggcgtcaatttttaacacgttatgtttggttctaaccattgcccccaacttggctaacgtttctggtgacgaatagaacatatcctccaagtgattgacctttcccccgagataaaggtagatcccacatgataagaatgaaatattgtcatcacgctcataaatcgtgaccgtagcctccggatgatccttcagaatttgtgcagccgcagcggtccccgcatgcgtacatccaacaattacaatcttcatttcattttgctcccaattataattttatttatttaaccataggtatattataaccgctttactgcgcaaatacataactctagttaatataaatacaggtcatgatgaaacataactacttttaaaaaccaatcagcgatacgctggcaagcagttattctcacaatatcatccataccagctttgccaggtaaccactaattgactttttactcattttcagaaaattaccttgttcaccaagcagtttagcacaatcatcatcagcccaattgataatcgataccatgcaaaaaaagatggtgtcaaacagtttcacttattcattttttggtatagtatgtattaggaagcatcaaatcgtgttaattcaagtctaaggagttcccttatgtaccgctattttattcagccccagttagataaatttaataattcactgattggctacgagatgctgattcgctatcgtgagactgatcaggaccggtggaccttaccagaaagcttcgataatattccgatcgatgtacaagtcagcttactaaaggctacggctagtgagcttgcattaaaaatcgggtcagtatcaattaactttaatcgcaagcaatttttaaatgatgatattgctgccgcagtcattgatgctcagaaaaagctattcccggttcatgttatcgtcgaagtcacagaagaacccggcgaagatacgtttacactggcggcgatgcaacaacaaattgataagtacaaggctaacggcctacaatttagcattgatgacgttggcacgggaatcaacgtttacgaccacattaaaccgctactcgaatcggccgaagaaatcaaattcgccatgcaaaactttcgggccgaagatcgtgaaaacgagattcccattcaattaaaattctggcgcgacattgcggtacaacatgatatccggttaattctagagggtgttgaaaacgatgccgaagatcaaatggcgaatgacttaaatatttcactacgccaaggttattattatggcaagccccatttattcaaattaaaagccgaccactaggtgccagcttaattagtgaatcgcaattattcagcagttaactaaaaacaaccgtgaaatcttaatagatttcacggttgttttaattaatcaagtattatttagttggtttcttcgttgttttaggagcggcgctatcttctttagataacttagcaccaagatccttgatgtaagtccgcaagtcagccttaacatccggatgagttaacccgtattcgatcgtcgtcttcaagtagccaaacttgtagccaacatcgtgccgagtccccttaaattcatgggcaaagactcgctgagtcttgttcaacgtatcaatggcatccgtcaattgaatttcgtcacccttaccaggtttttggttttcaagaacatcaaaaatttctggtgttaataagtaacgaccaatgatagcaagatcactaggcgcatcttcaggtgatggcttttcaacaaagttattaacgttgtataggcccggttccttttcactttcaggattgataaccccatacttagaaacttcctcatgaggaaccttcataacagctaacgttgacgcatgtgtcttgtcatagctattcattaactgtttggttaacggtactttgtcttccattaaatcatcaccaagcatgacgacgaaaggttcgtcaccaacgaaagctttagccgttaaaacggcatcgcccaaaccacgtgggtgtgattgccggataaagtacaagttaatgtctgtggtttcttgaaccagcttgagcatttcttccttgtgcttagcccgtaagttatcctctaattctgggttagaatcatagtaatcttcaatactacgcttgctcttacccgtgacgataacaatgtcttcgatccccgatttacgagcttcgtcaacaatgaactgaatcgttggtttatcaacgattggtaacatttctttaggcatcgccttagtagcaggcaaaaaccgtgttcctaatccggccgctgggataacggcttttctaacttttgacatgtgataaatcctcctaaaaatagtgaaattagtttggaaattcctactgaatctcaggtttcccctcgcgccgcatcaattgtggaatgacttccttaatgtcggcactcttatataatacatcataaatcgcttcagtgatgggcatttcgatattttgttgctgtgcaagctcgtaagcggctttagttgacgggataccttcaataaccatgcccatggtatcaatcaccgtcttgaggtcctgaccagcacctaactcattaccagcgcgccagttacgcgaatggacactagttgccgtaacaattaaatcgccaacaccggataaaccgataaatgtcaacggctctgcgcccaacgccactccgagccgactgatttcagctaaaccacgagtcattaaggctgccttggcgtcatcaccatagcccaggccgtgtagcgcaccagcacccagggcaatgatatttttgagcgccgcacctagttcaacaccaaccacgtcggtattcgtgtaaatgcggaaatagtcattcatgaagagttgctgtactaattcggctgcagattcatcggcgctagccgccgtaatcaacgtaatatcgtggcgggccacttcttcagcatgactagggcccgataagacaacgatcgcttgtcgtaattcggcgggaatttcttctgccaaaacttgcgacagccgcttgtgtgtctcttgttcgagtcccttgctagcatgcacaataatcggccgctgatgggtcttggcaagcacggcagtcacttgttgggccacttcgcgaatcgctttggttggtacgacaaacaagattacatccgcaccatcaatcgcctgtgttagatttgaataagcagtcaacgtttctgaatatttaaaatcaggaacgtatcgctcattcgtgtgttgctcatttaattctgtgacttgggccggtgagtacgaccagagccgcactgagtggccattttcatccaacagatttgccaaaatgctaccccatgagccagcacctaaaacggcaatttttttcatcattcaaataaccctctaatctacttattttctgcgacaaccttttgaccagaacccgctaaataccaacgattattcggattgtgatgccggcgccagatcattaagccaatgctaccaaagaacagtaccactgacaacgcttgtgagacccgaataacgttaaatagcatgagcgagtcagtccgcatcccttctgtgaagaagcggccaaaggcgtaccaagcaacataagtcaagaagacatcaccctgcttataccaatgtgtgcgatgacgcgtgagcatcagtaaggcaaatcctaatagatcccataccgactcatacaagaatgttggttgccgatacgcgccacggatatacatctggttaatcagccaatcaggtaagtgcaagccttgtaagaaactcagactagtcactcgaccaaaagcctcctgattcataaagttaccccagcgaccaataccttggcccatgatcaccgttggtgcggcaatatcaagcattagccaagttgggataaagcgtgaccgacagaataaaatgaccacaattccggcgccaatcaagccaccatagatggcaattccaccatcccagatacggatgatttcaccgggattctgacgataatatgaccactggaaaatcacatagtaagtccgcgccgcaattaaagtaaacggaagtgcccataaaatcatatcgtaaatgtcatcgggccgaacaccccgtcgctgaccttcacgtactgctagtgcaaccgcaatgacgacggcactagcaataatgacgccgtaccaatggacctgaattggtcctaaccgcagtgcaattgggttaagtgcccctaaaacggtattcacgctactgccatctccttattacttgtgagaatcatgcacggaattcgttttgatcaacttgttcaagttatcgtcaaagaccttggtcgcatcgtagcccatgctctcggcccgaaagttcatggccgctgcttcgataatgattgctaggttacgtccagtcttaactggaatcgagatttcaggaacttcaacatcaaagaatttccggttctgttctccatttcctagtctatcaaattgcttatcaggcgtccaattctcaaggtgcacgataaggtcaatgtcggtatcttgacgaacagccccagcgccaaaaagattcataacatcaataattccgatacctcgaatctccaataagtgattcaagattgcgggtgcttcaccgacaagcgtttgttcatcctgttgatagacatcgacccggtcatcagcaatcaaacgatgcccccgtttgactaattccagggccgtttcactcttcccaacaccggaatcaccagtaatcagcacacctaatccatagatgtcaactaataccccgtggacagattgtcgttcagctaatttaccttccaagtaattcgtcatattacttagaatccgtgatgatgtcattttcgttcctaaaatcggcacgccattttcctcaccggcttgcacgagttcttctggaacgggtaaccccgttgaaatgacgaacgcgggtgtggttaactgacacatcttacgaaaaatcatcagtcgttcatcatgactcatatttttcgaataagcggtttcagttttacctagcaattgcactcgttcacgaggatagtagttgaagtaaccggtcaacgccagccccggacgtgaaatgtcgctcgttgtaatatctttcttttctaataagtcagcgccatgatacacatccaggcgcgtatttttcaccaaatcggcaacggttacacttcctgccaaaagaatccctcctaattgttccactaataaaaaagtgtggcccgcgttgtccagtcgcgccattacgctaccctttcaagcggccacacttttatgactgaaaacggattatttctatcttctaatcttagcactttaaagcgctttattcaccatcaacgccgtctttcgcgaaaaagttggaaacaatcacgttagcaattgacatgagaatcgaaacaaccatcgccatgccaaaactcgaaaagccgaaattggccttacccacaacgtaggatgtcatctgaagcataaaaccattgatgacaatactgaatagcccgagtgtcaataacgtaatcggtaacgataataacagcaaaaacggcttaatagcggcgtttaaaattgcaagcacaaaactggcaattaaagccatccacacacttgcaacgtgaaaactgctctgaaaaaagccagcaatcgcaataaataagattgtattgattaaaattcgtttccaaaagcccactgtataatcactccattaatcttagtgacgcggatcatcctcttcatgaacgttatgaatctctttgcgcccatgcgcttgcggtttagcttgagtaccggtactttgccgcatctgttcgaagaaacccgtattgtctggtttacttgggataattgtcattaatactaagtataccaaaacaccaaagccatgggtaaccaaggttaaaataacgtagagtactcgtagaatcgttgcattccagttcaaatattcagcaatgcccccgaggacgccggcgaaaacgcgattattagatttagttaacttttgttttgtatttgatttcatcgttagacgctccttatcagtttatctaaccatatcttactaattgtaaaagccggttgcaaactagacgaccggctttaagcaattatttatgattagttacactaaattagaactttctggattcaattcgataatctcaccagtattcaaatacacgatccactcaccaatattagttactaacgccccgatgcgcattaagtaagttgcaacattcaggtaatccgtggaaccgatgaccgtctcaggatggcgctccatcttggagatccccttctcattaatacgatcatacatctccccgacttttgcgtctttagctgcgacccggcgtgcttcctgatcatcacttttgacgtaagctgccaacatctcttcgaccatctttcgcacgcgattccccatttctgataacgctgcctcaatttcagggacgcgcacatttcctttgacccgaatcgtagcgtgagcaatattacgtgcataatcggccatccgttccaattcagagacggctttcaaaatggtgacaatttctcgcaaatcagaagtgacgggttggtataacgcaatcatctcaaatgatttctgttctagttcaacttcccgttggttgattttagcatcattatcaatgatttcttgtgcgaggtcgcggtcatggtcgataaacgccttgactgccttttcaatcgtctcgctaaccatcattcccatttcagtgaagtttgcatcaatatcgtttagttcatcatcaaaaagtcgtcgcatgtttttttcctcctaaccaaatcgtcctgaaatatagtcattggtttcctgtttaactggattcatgaaaatctgtttcgtgtcgttgacctcaattaattcaccattcaggaaaaacgccgttcggtcagaaattcgtgacgcctgttgcatgttatgcgtaacagttatgatagtgtaatcctggcgcaaattcaatagggtttcttcaatcatccgactcgatatcggatcaagtgcactagtggcctcgtctaaaaggataatatcaggttcgacggctaggacgcgtgcgatacaaacccgttgttgttgcccaccagacaatgatagcgcattggcatgcaaccggtccttaacttcatcccaaattgcagcctgcttcagacttttttctaccgccgcgtctaagcgttctttatcatggactcctgccaaccgtaacccgtaaatgacattctcataaattgagaatggaaagggattcggctgttgaaacaccatgccgatctctttacgcaattgaaccgtatcggtcgtgggcgcataaatattgtgaccattgaagttcacctcacccgtgatcgttacattaggaatcagatcgttcatccggttcaagcaacgtaaaaaggtggatttaccacagccagagggcccaatcaaagccgtgattcctttatcatcaaaatcaatgttaattcctttgagggcctcttttttaccataaaataatgataagttctcggtcgttaaaattgtactcatgaacggtcctcctatccaaagtttccggaaatatagtcattcgtcagatcaacctgaggattggtaaaaatctcaccggtctctgagtattctaggactttgccgaggttaaagaacgcggtatagtcgctaattcgcgatgcttgttgcatattatgcgtcacaataataatggtataattctgctttagttctaacaaagtatcttcaatttgacttgtcgatactggatccaaagcactcgctggttcatcgagcagtaaaatgtctggcttgattgcaattgcccgagcaatacagagtcgttgttgctgcccgccagacagagctaacgcacttttatttaagtcatctttaacttggtcccacatcgccgcttgccgtaaagaccgttcaacaatttcatccaagtcttgtttcttgttcattccgcgctggcggagtgcaaaagcaatattctcatagattgatttggcaaacggattaggccgttgaaacaccatgccaatgtgccggcgcatctcatagacatcaatatcattactgttaatatctaagccgcgatacataattttgcccttaaccgttgcaatacggtcattcattcggtttagcgaacgcaagtaggttgactttccggaaccggatgggccaatcaacgcactaatcttataacgttcaaactgtaaatcgccctctgaaatagcctcggatttaccataaaagacgtgtaaatcctcagttgaaagcgcgatttcatgatctttaggatcaaacgccatgatgttacgttgtgtcgtcgtcattgtgttatctgccatcaaaacggcctcctttattcagcggttaagtgtttgtacaagcgtttgccaagccaacgagctaagaagttaaagagcaataccgcaataattaatacggctgaagcccccgccgaaacggctttcgcgtccggcataattccttctgagttgatcttccaaatatgaacggccaacgtttcggctggacgtagtggactgagtggactactgatatcaaatggattccagttaccaaagtccaaggctggtgcactttgacccgcagtgtagattaaagctgcggcttcaccaaagatccgcccggcactcaagacgacccccgttaaaatgcttggtaaggcagcgggaaccacgatcttcgtcaccgtctcccaacgtgatagccctaacgcgtagccggcctcccgttgattatctgagatattggcgagtgcttcctcaatactccgggttaaaatcggtaagttaaacacggtcagcgcaaacgccccggaaagaatcgagaagcctaacttgaactgcactacaaagaacaagtatccgaacagccccacgactacggatggcaatgaactcagaatttcaatggtcgtccgaatcaggccagtcaccgtattttgcggcgcatattcatttagatagatccccgcacccagtgaaatcggtaatgaaatcaataacgctaaaaatagtaagtagaaggagttaaacaactgaatgccaatcccaccacccgcttcaaaagccagggccggcgacgttaaaaaatgccacgaaattttgggcaccccttggatcagaatgtatcccaatagggcaactaagatgatgaccacaaaagctgcgacgccgtatagcacgccagtggcaattttatcgatgcgtttagcgttcatggtttaatttcccctttcgaccaatgtagcgaatgactaagttaaagactaaggacatcaataacaggatcatggctaatgaccacaatgcattattttgtaatgaacccatgacagtgttcccgattcccatcgtcaagatacttgtcaaagttgcggctggtgaaactaggttatgcggcaacaacgtcgcgttcccgatcaccatttggaccgccagagcttccccaaaggcgcgggccatcccaaatacgacggcagtcagcatgccaggaatggctgcccgcaggacgactttataaattgtttgccagcgcgtcgcccctagagctagcgaggcttctcggtaataacggggtaccgaattcagcgcatccgccgtcattgacgtcacggtcggtaagatcatgacaaatagcacaaaggtcccagaaagaatcccgtagccactacccccaaacgtattacgaacaaacggtacgacaacttgtagcccgataaatccatacactacggatggaataccaactaatagttccgtaactggccggagaatcttcgccccccggcgtggtgaaatttcggtcataaagaccgccgtcccgatagcaaacggtgtggcaattaaggccgaaagaatcgtaatcaaaaacgacccaacaatcatcggtagtgcccccacagctggttgcccattcgttccgactgttccggggttccactgcgtcccactcagaaattgccatagattaatgtgattttgaaaaaaggttgctaacccccgtgatgcaacaaagtagaaaatcaaaaagacaatcccgacaattagcgctagacaaactagactaatagccttaccacgccgttcaattttactagcaactgatttttttaataagctttctcgaattttatccatgcgctctccctcatttcataactgaaactttaccggccgcattccgctgtacttgcatgtcatggaccgaaatataacctaactgcttgactaacttctgctgaacagcggttgataaaatgtaatcaataaattttttggttaactgattggggtgcttccccgtatataaatgttcgtaggaccagatgtaccagcgattattccgcacatttttttcggttggccgaataccatcaacattgacggtctggactgatttgtctaagtaagaaaaagccacataactaattgcgccaggtgtactagcaacaattgaccgagctaatcctgacgaatcctgttcttgggaatcaacactctgattaccctttaaggcgtatcgctcaaatgtcttccgagttccggagccttgagcacggttaattaacgtgatcggtaaattacgtccaccaacttcacgccaattcgtgaccttgcccgtaaaaatctgaatgagttgctgctgcgtcaaattggtaatgcccgcctttttattaacgatgggggcaataccgacgacggctacccggtgatcaattaacttgctcgctgtaatgccagactgttcttcggcaaaaatatcagaattaccgattgccacggcccccgcctgaatttgactgagtcccgttccagagccaccaccctgcacattgataaacacaccggtatggttgctgctgtattgttcaccggctgcttcaaccagtggctgtaaggccgttgatccaaccgcggtaattgattcactggcactagttcgatcacgatgtgtgtaccctaatccaactagtccaatgatcgcgattaacacgattaattggatgacccgactttttctcataactatatacctcctacccattgctcatattcaataatacaaagtttgtgtaaatgctttatatgagttttgtaaagattgtgtaaacgtcgatatatttttaattattaccggcttttagcccccaatatgaaaggaaaattaaaaaagtgcacaaaaaacgattttcaaggtttacatttaccttaaaaatcgttatcaattcgtctggcttaattacgacacattcaattctcaactaatgacatcttttgactcagcaatacaactcataccgtcaccacgtcatcatttgatagaccaccagttacaatcagaactgtccgtatgcttaacgccttactactgctcggaagcactcgcagctagtggcaatgtaactgtcatagttgtcccaacgccccgttgactgacaacgtcgattgttccgtgcattgcgttgaccaattcttgaacaatcgctaatccgagtccagtcccactcacaagttgctgtgaacgtgacggactcgcccgatagaagcgttcaaaaatacgctgttgatcatcggcactgataccaatgcccgtatctttaactatcagcgaccacgtttgatgactgaccatggtggcaatcgtcacgctaccatgaggtcgattatacttgattgcattcgttaacagatttttgatgatctgactcaacttctgtgaatcgctcgttatcattagatcagcatcgacttggttattgatcgttaagtgctgacgttcgattgcctgctgaactacagccagttcctgttcgatcagtggtcgaacagcaagcggagctaaggttaacatcgtcgtattctgagcacgaattcgcgatagcgacagaacatcctgaatgagatcaatcaaccgttgactttcatccgcaataatatgcaagaattggtcaagcgtgtccggatcatccttggcaccacttaacaacgtttcagtgaaaccggaaatggctgtaatcggcgtcttcaactcgtggctagcgttgctgacaaaatcatcctgcatttgttcaatcatatagacttcagtgatatcatacaacatcaggacaatttgaaattgtgaacgattgccttggatataaacggttgaagcctcgacaacctgcgtgttaggcgctggggtcagcgtaatcgttgcccgttgatttttgccactagtaatcgtatcttcaatcaatttagtcaacgcgtacagctgaatatccttggtataaatgtgggccaccgtattaaccgagacttgcaatagttcactcatcgccggattagacagttgaacctgtcgccggtggtcaatgaccatcactcccacaggcaagtaccgcataatcatcattaactctttttcttgcagttccgcacggcgcgtctgacttttttgataactctctaactggttgactgcttgtgctaggctgtataaggggtccgattgtggcaataagatatgtggtggaaattgctggctactcatctgacgaagcttagcttccatacggtcgatcgtgcgctgccgttcactttgttgccgccaagcaatcaagccctcgattactgccaaaaccagccaagcaccaactaaacaaccgactaggcgccaggaccacttaattggcgaaaagtgctgcaacacgaccaacacgatcaaaaccagtaacacattttccatgagcaataaccgtgtcgtctgttgccagcgattatgcatggccgtcacccacaaattcgtagccaaagccccggaccgtcctgatcaaccgtggctgcttgggatctgcttcaatcttttcacgtaaatgtgagatgtgaatatcaacgatccgcgtctcactagcatagtcgtagccccagacgtgatttaaaatcgcatcacgactgaggacccggccctctcgttcaacaaaatacacgagtaattcaaattcctttggtgtcaaactgatatttttcccgttgcgcgcgacccggtatttgttttgatcaatctgtaaatcaccaacaagcattaccgcacgattagcaggcggcatgggtgccggtggtgtcacgggctcgtccggcgttgtccgccgaataactgctttgatccgagcgagcacttcgcggggtgaaaacggcttggttatataatcgtccgcacctaattccaagccgaacactttatcaaactcatcatttttagccgtcacaataataataggcgtctgaaccttttcttgtcgtaacttttttgttacttccattccatcgagtttcggcaacatcaaatctaataaaatacatgtaaatgattgggccaggcctaatgacaacgcgtccgcaccatccgtcgccgtcacaacttcgtaccccgcctgcttcaagttatatgataataacgtgacgatagctggttcgtcgtctaccactaaaatcttatccatggtcattaatcctcctgatcagtgaataacacaattcctaactcgtgtggggcgccattatagatcgccgtttcggtaataattaattcctgttgccgattgcgcactttaaggtgaacatacgtcggacttttcagtagggccgcgtaaaattcagcttccgtattaactggttgccggttacattccaagataatatctcctaaatcgagatttaatttatccgcgggcgtgtgggggcgtaacccaatcacccgcacaccttgttcagtatcagaatatcgaaactgttggtgtcgatcgtgataacggtgctgtgctaagattccccaagttagcacaacgattaatcccatcaatgctagcaaccactgcgggctgagcactgcaaaacgggcaatgattgcaaccaaaacactcgcgagtgttacccaaccatagcgggccgctaactgccgccatgcaatttgtggcagctgcttataaacgcgaacactcgtcccaactaataaaggcaacaataaaatgctgaaggagcgctcgccaaccataaacacaggccaccaactgatagttgcgtgtaaccaatcaccggggaccagtaccccaactggtaagaccaacaattgttgccactggtaacgaacaagtcgctttccacgttggtcgggctgtagttgcggtgaacggccctcataatcatagtgtcgtaacaagaccgccgtagccgccagcacgatggctaataacaatagtccgttcaccaccaaattgccactcatactggtcatggcaacaccgtgccgttgtaaagcgccccccaccgtcgttaattccgggctcataatccaataaactaaccagctgaggccaaaagcggtcactggtaccagtgcaccaggaataatgatcaagctaatggccgccactacttcgtatataaccacccagatgggggccaccactagtcccaatgccaagctaataattgtcattagaactcctagtaaacagccatccactaaaaagtggtggacttcaactaattgtgggttgatagcactctgaaaatgctgccgttcactcttcacccgccgtttagcggttaaataactacgcagcaatcctaaccaaactagcggttgtaaaagaaacaattcaaaaatctttaatacctgcatgtgcgtgacccctaacgttaaactctgaagttagtatagcatttttgcccaaggagaccaacgccgtttcaattccgttagtcctgctattaccgctttaatatctctatattataagactagtagccaaaaaaatactaagacgacctgcgcaatgataggtcaccttagtatttgtgcaatctattgcggattacgttgggctaatttccattgtaagtaagcatccataaacgaatcaagatcaccatccatgacagcctgcccatcatgtgattcataattagtccggtgatccttgaccatcgtatacggatgaaaaacgtaggagcgaatttgtgagccccacccaatgtccatttgctcaccttggatggccgcccgttccttagccttcttctcttcttcacgttcgtacaacttcgctcgcaacatgttcaatgctgtttgtcggttctgtaattgtgaacgttgtgcttgactggcaacgacgattcccgttggcacgtgggtaatccgaaccgctgaagaagtcttgttgacatgttgtccaccggccccactggctcgataaacgtcaatcttcaaatcttcaggtcgaatatcaacatccacggtatcatctaactcaggcatcacatcaacactcgcaaaagatgtgtggcgccgaccagccgcatcgaacggcgaaatccgaacaagacgatgaacccctttttctgaccgcaaataaccataagcattgtgcccgctaattaataaagtcacactcttaatgcctgcctcatcaccagcttggtagtcaacagtctcgactttgaaattgtgactcgcagcccagcgcgtgtacattcttagtagcatcgcaccccaatcttgggattcggtcccaccagctccgggatggatttctaaaatagcattattgcggtcgtacggaccgtccaaaagtaagttgagccggtactgttgtaaatcatgttcagcgtgctgaaagtccgtttcaaactcagcctgcatctcagcatcgggttcctcactcagtaactcataagcgactgccaagtcaccgacttcatcagctaattgcttaaacgtatcatactttcctttcaacacgttattctcatcgatgactttctgggcggcagcctggtcgtcccaaaaaccgggttcggccattcgagcttcattttcttgaatgctttcgttcaaagcatctaagtcaaagcgaccccctaaagtcgtcgacagcactttgcatttcttcaatcaggtgtttatattcacttaattccacaaaggacccttctttcaacttatttattaattatttaatatctggtttaactgtaaaacgagcctaagaccttagtcttagactcgctagcactaacgttaaattttaacgctgaatattttggcgaatttcagacttcatgaagagtcgcgtcgtatcataatcaatatccgcaaccatttcttcaaacatctggtaaccgtctcgttgatattcaactaacggattcaattgaccatagccccgtaaaccgatcgattgccgtaattgatccatcgcatcaatgtgatccgtccaatgagaatcgaccactcgcagaataacgactttttcaaattctagcatctgacccgcatcgtaaagctgtttagccttgtccgcataaatcttatcgacccggtccatcaagtaagcttcaacctctgctggcgacttacctttcaagtcagccacactaattgaatcttccttcaccatagcagcttgggcaaagtcaacaactgcatctaaatcccagtccttggcatcgccttgcatgtgtaactgaacggtccgttcaacggtccgcttgatcattggcatgataacgggctttaaagatttttcttccataatgacttgttgccgctcgccgtaaatcacttcacgttgagcccgcataacatcatcatattgtagaacgttcttccgggagtcatagttgttcccttcaacccgtttttgagcggactcaacctgtcgagtaatcatccgtgattgaataaccgcatcatcatcttcaacattcatccgttgcaggaagttcttgattcgttctgaaccgaaccgtagcatcaaatcgtcttcaagtgagaggtagaattgtgacataccaggatcaccttgacgaccagcacggccccgcaattggttatcgatccggcgggactcatgacgttcagtcccaataacggcgagccccccgacttctttgacaccaggtcccaacttgatatcggtcccccgaccagccatgttggtggcaatggtaaccgcaccacgttgaccggcgtttgcaacaatgtcagcttccttcgcatggttcttggcgttcaagaccacgtgcggaatgttttcctcatccaaacgatgcgacaagtattctgacgtttccacggcaacggtcccaattaacattggttggcccttttcatggagttgtttgatttctttaacgaccgcgttgaatttgctttgtaacgttgggtaaagcaaatctgaacggtcatcacgaatcatcgggcggtttgttggaatcgtaataacttccatgttatagatttcgcggaattcttcttgttccgtcttggccgtcccagtcatcccagataactttttgtacatccggaataagttttggtacgtgatattcgccatcgtcttggtttcttcttgaatctcaacgtgttccttagcttcaattgcttggtgtaacccgtctgagaagcgccgaccatccatgatccgccccgtaaaggaatcaacgatcaacgcctgaccgtctgaaatcacgtagtctttatctttcaacatgatgtagttcgcacgcaaagcttcatccaagtaatggttcaacgccgtattatcagtatcgtaaaggttttccaagccaaagtatttttcagccttccgaatcccttcgtctaataatgcgaccgtcttagattccaagtcaaccttgtaatcttcatccttcgtcaacgtcttagcaaaacggtcagcccgcttatacattcccgttgtaccttctgattgaccagaaatgatcaacggtgtccgggcttcatcaattaagattgagtcaacttcatcaatgatggcaaaattaagtggtcgttgcaccatgtcttcacggtagaccaccatgttatcacgtaagtaatcgaacccaatttcaccgttcgtcgaataagtaatatcggcgttataagcggcacgtttttcttcaggcgacttttcagccccgttgattccgacactcatccctaaccagttatacagttcacccatttcagtcgcatcacgcgctgataagtattcattaactgttacaacgtgaacacccttaccagagatggcattcaaataaactggcatagtggccgttaaggtcttcccttcaccagtcttcatttcagcaatgtcaccttgatgcaaaacgattccaccgaggatttgaacgtggaatgggtataaaccaagtacccgcttcgcaccttcacgcgccgttgcaaatgcttcgggcagcaaatcgtcgagcgattcgccctccttgtaccgttcacgaaattctggggtcttcgcttgcaagtcagcatcacttaacttgccgtattcgtcggcataagcttcaactttattagcaatcttatccagacgccgaatagtccgcttgtcgctttcaacccagcgttttaaaatgttggccatttacgtatcctctccaaataattaatcttaattttaatttcaattgtccatttcaaaataaaataccatctgtcattttaccattatttactagcaatgaaaaccacaggcccctatgtaaccgataccgtcgaccgttttatttacatccttaactaaatattagtctttaaccacagcccaacaatcactgacccgtgttctttaattctatcaatatttgcttaactgtcttgagtcgctggcaaaaacgtgccgtgagtcgaacttcagcttactaacgcgggctaagtcactctcatgatcacaatatgttatacgggcgttccgggataaaaataaagaactggtcaactgaccagtcctcataagttgcgcttttaaaattagtgattgtcgtcggtttcaatcaaaccgtaacgaccatcgttacgccgatagacgatgttaattgcgtccgtttccgcgtcttcgtagataaagaagtcatggccgagcatatccatttgcagaatcgcttcttcattatccattggctttaaagccactcgcttcgtacgtacaacgtctaacttatcgtcctgatcattgtcggcagcggcaactgtttcatcagtcgctgcaaaatcaatcgctttataacccttttcacgggatttgcggttaaccttagttttatacttgcggatttggcgttccaacttgtcagtaaccaaatcaacactagcatacatatcaggagaagtttcttctgcccggagaactaaatagggaagtggaatggtgacttcgactttagccgtcttgtctgggtgaacttttaagttgacatgggcaattgagtcaacattattgtcaaagtacttctgtaacttacccacccgtttttgaacgtagtcccgaattgcttgggtcacttcgatattttcaccgcgaatattaaaatttagcatagatcttctctcccttcacacacattgctgtgtacccaaagtaattaaaggaccactctttaattactttgcttaaattcattataatagaaagcgctataataaacaatccaaataccactttccctcgaaattaacgtgctagtgttagccccgtcacgctcttggcaccgttttccaaaagtagcgttgccgcgtggcgcatcgttcggccggtagtatagatgtcatctactaataatacccgccggccggccaaaatcgtattaggagccatcttgaatggttgtggtgttctcaaccgcgcttgccggtctttcttagattgtggcactgacttcgctgttgcctgggtcattaacccgggcgcgaggggtgcggctaaccagccggcaacttgattaaagccccgtgtttgcaacgttgtgggcgtgacaggcaccactaagcatatctcagcacaccgttgtaccactgcttgttgcatgatcttcgcaaagacttggcgtaattgataatcaccctgaaatttatagcgttgaaaataatcatgcatcgcatcattatattcgaacaacgcctcgttatgaaagggaccgatttcaggccaccactgacaatctgtacacggttgcggtcgcttttgagcacgtccacatttggaacatgccgttgcccgatcgatgcgtacaaattgccgccaacaaaccgagcagacgaccggccgcataaccggctgccagctaagaatccagggcaacgtaaacttagtcgtgataatgttgtgacacagtaggcatgctagcacgtaattgtcgcccctttcgattgatcacccgaatctggcgctgagcgcgtttgatattgcggctatgactgtgacaaataaaccagacgaggccagtcggacgctcactgctgcgtccgacccgtcctgcaatctggacgagggcagccgtagaaaacacttcgtcgtccgcaccaagcacaatcacatcgattcccggaaacgtcacccctcgttccaatatcgtcgtcgtaactaagtattgaaactgctggttccgcatttgttgaaccttagtcagtcgctcaggatcggctgagtacaccgtctctccggtcatatggggaaaatagtgttggagtaccgcaaacactggcgctaattgttggatgcgcgggacaaatagtaaaaagcgctggtgctgttgttgatactgttggagttgccggataaggtctcgtggtaattttccttgttgcaagagccgagcccaatttggctgtagcttaaccttaattgccggtaataaatgttggtgaaaccgcaatggtaaataactgattgcaagctcaccacgatgaacttgggacaacaaactttggctgggcgtcgcggtcaaataaagaatggccccctccaccttagctgcctgattcactgcaaacgccaaacggggattggcagcaaacggaaacgcgtcaacttcatcaatgatcaatacgtcaaacgcctgacgaaaacgtagcaattgatgcgtcgtacaaatcgtcagctgcgtatactgatagggagcgggattgcggccatgtagcacagcaatttgaacatcagcaaaggccgcctggagccggggtgctaactctaagcaaacatcgactcgtggtgaagcaatggcgacccgccactgatgcgctaacgcccacgcaatacctggaaacagcatttcagtttttccagctcccgtcaccgcccataataattgccgtttatgcgccatgaagttagctttgattgattgcgcgcagtccgcttgctggggcgttagggttccttgccacgtgcaaaccgggaccgttgcaaaagcattcggttctggcatatgatagagtttaactagtgtactcactcgacctaaatttaaacattgataacagtaatattgctgattgggtaattgggctcgcagtcggtccaagtgactgccgcaacgctgacagataatttgatgttcatcaacctgcatggctggcagtatctgcgtgccagcaggtactgcggcagcctcatttgcagataatgcgagctgacgaccgtataagacttgtgcttccatcgtgcgcacctccttagttatcaagtacgccatttaacgatttattcacgaaaggaaccgattaatttgactaaaccctactacaccatcacccaagacacggtatttgaacaaaccatcaaaaagtctcgcttcatcgctcatctatatcgcatcagtgacgaagtggatgctcaagctaagattgccgctgttcgagcagataatcctaaggccaaccacaactgtttcgcctacatgcttggtgatgatgatcatattcagcggatgagtgatgacggtgaaccggtcggaactgcgggctcaccaatcttagaagtgctcaagaccaacgagctacacgacgtgcttgcggtcgtgacccgttattttggtggtatcaagcttggcgccggtggactgatccgagcttataatggcacccccgcgcaagcaattgaagtcagtggtaaggttcagcgaatcttacaaacccgcatcgccatcacgctcgactatcgtaacgtcgatgctttaacctactatttacaacaaaataagctaacgactctgaataccgactacggtgttcaagtcacacaaatcatcgcagtcactcaatccgaaattgcaacgattcagcaggacatcactaacctcttgagcggtcaagttaccttttcggagcaaggtgaacaatttacagaaattccggtcactacgcctggcaactagattgctggttatatataattgggagcctcacaaactttgattggcagtcaaaatcgaaacagccaactcgtcttaacaataacacccagcacttgagccgatgatttgttttttcattgttaaagtccgcgttgcactaattgcggcccataaaaaaagtcgagctatcgctcgactttttgtctgttatttattttaaattagtgattgcaccagattggccacgatcaaccttcatcgaagtcaatggaatatatcctaatttctcaactaaactaccttgaacggctttagaagtcatgtaagttaagaagttcttcaactccccagttggttgccccttagtatacatgtgttcataagcccaaatcttccacttgttcgtcgctacgttagcttcggttggtttgacgttatcaatagaaagcgcctgaacgtcactcttaacgtatgagaatgctaagtaactgatggcaccaggcgtggtgctaacaattttttgaacggtcccattcgaatcttgttcttggctagttgcgaccttcgcgttgtctaatccccatttttcaaacgtcgcccgggtcccactaccttgagcacggttaacgacggtaatcttttcgtccttaccgccaacatctttccagttagtgatcttgccttggaaaatcttgataagttgttcttttgaaatattagtgacaccggcatccttattaataacgggtgccatccccacaacagccactttatggtcaactaaccctttggcgtctaaccccttttgttcctgtgcaaataaatcagagttcccaatattgactgaacccttcgccacctgacttaagcctgctcctgaaccaccaccctgaacgttaatggtcacgttagcatgttcgttctggtaagcctgtccagcctgttccactaatggttgtaaagcggttgaaccagttgcaacgatcttagtagtcttggaactaccactactgctactagtactcttcgtacttgtggctgagctactgccgcaaccagctagtaaaatggtcatcgttactgccaatgcgccgagtgtcagtgcttttttcataattgaaactccccttcttcaattgactatcaaaattaagcaaccaacccggcaaccatcatagcaaaactgggtaggagtgctacgactagtgatggagcaacatcaccgtccgacggttacacgtaattgattgcttcggaacatgcttaatattactaatcgtttgtaaattgtgaatgacgattgtgtaaattgcttgtatagttttggtaaagttaagattgatgaaccaactgatgaccaactaaaaacaggcatcaccgctaatcacacggtagatgcctgtaacactttaataattttcaatgatttatttggtttttaatgattactcttggaggtcaaacgcgcgacggtccgtttgatccaatccagtagcggttgccgattgtcaccagctaatccgattgcttcaacgaataactctagcccaaataataaaccaatcgtcaataacacagaaccccaaatagatgagatcggatagagcaatgaaataaatgagaaaataagtgcaatcccataaattaccatcacagtctgtcgatgggtcaatcctaattgcatcaagcggtggtgcaaatgatgcttatccgcttgcgaaatgggcttcttattcaggatccgtcgaatcatcgcatacaccgtatccgtaattggcactcccaggatcataaccggaataccaactgagattaaggtgacatttttcaatccaaataatgagaacacagccgtcataaagccgataaacaacgaaccggtatcaccgagataaattctagctggaaagaaattatacggaagaaagccaatcatcgccgcaactaaagtaaaaatcaacaacgaaacgaacatattagcattcaagaagaacaacccgatgatccccatggtactcaacgaaataatcgaaacaccggtagctaacccatccagtccatcaattaagttcaccgcattcgtgatagccagtatccacagtaaagtcaccggtaaactcagccactgaaagtgaatcagccccagcaacgggaacgtgaaggtcgtcattcggataccaccaataaagtagacctccaaagcggctaacgtaatccctaacattttttgccgtggttttagctcataaatatcatcgataacaccagtcgcaataatgatcagctcaccaccgagtagtgcgaaaaaaatgcgactgggaaactggtgcatgagatacaacacagtcgtcccaacggtgtaagagataaaaatagccaagcctcccattgtcggcattggaattttattgacccgtcgtacatttggtttatccacggcaccaattttaaatgcaagtttccgcacaaacggcgtcaagatcgcagaaagtatcatggtcgccactaggcttactaggatttcaaatctgatcatttgtgcgtaactcccttctcactctattatgataattatacaaatcccagtgacgcttgacaactcgcttcactaaaacttagtaaaggcaacacaattcgttcacatttgccggtcactgggctgattaagtatctaaattataaccttagttactcatattatgacacaaaaataaaaacccggtagctataccgggtttcaatactaagtcactattcttttaaatggtaattataagttgaaacaataatattttcacgagaatttaataccgctcgtaatcggagactcgtttgattatgcaaaatattctgccatggtttcttcggcacgaattgtgggacaagaaccgttgtcgagaagttgcgttccgctgctcgtttagcaatcacatcgcagaatcgtaacgtcggtgttgcaatcgaccgatacgacgaatggatgtccacgaaacggacgtctgggaaggtctctttgaactctgccgccgtcttgtgttccttttcagggttctcatcaaaggacacgtgcatcgcaatgacgtaatctccgatggatcgcgcgtagttgactgcttgagcagttacccgcgtcacattcgagacgaggacgatcaccgttgcaccgtcataatcatgaatcgccgctttttccttggcaaccacgcgtaactgggccgcaacccggttatagtgcacgtggattcggtagaacatgtacagtaagagtggcataacgattaagtatggccaaacattgccgaaatgtagcaagaataggaaaatcactaggagaattgaaatcaacgccccaagtaagtttaccgccgccttcatccaccaccattgcccccgctcgcggaaccaatgaataatcataccagattgcgacaaagtaaatgggacaaagacccccaccgcataaagtggaatcaaaagcgtcgtcttcccatgaaagataaagatcaacgcaattgccccgaccgccaatgagataatcccattggagtagcccaagcgatccccacgatccatgtaagcatgtggtagaaatttatctttagccaagttataagctaaaattggaaaggctgaaaaaccagtatttgccgcaacggccagaattaacgccgtcgataattgtaacaagtagtagaataagccgtgaccaaagaccgccgtagcaatttgtgacaagacggtattgtctacttgtggcttaacgcctaagtaataacttaaataagtaataccaccaaagaagacggccaagactaatgacatgattgctagcgtgttcgccgcattcttgcgtttcggtcgtttgaagtttggcaccgcattactgattgcttccaccccagtcagcgaggacgagccggaagaaaaggcccgtaagaacagcaccagggtcatcccttgaaccggtgctccaactgctgcggaggcgtggtaagttaagttaccactcgcaatattcataacgccccatagaatcatgccgataatcataataatgaaaaaataaacggggaacgttaagaatgatgcggattcgcgcattccacgcaaatttaacgccatgatggcgatgacaatcagtacggcaatcaatacttgataattagctagcgccggaatcgccgacgtgattgcttcagtaccagaagtgacggaaaccgctacggtcagcatataatcaaccagcagtgatcccccggcaactaatccggctggccgcccccagttcgtacttgccaccacgtaggcgccaccgccagatggataagcccgaataatttgtcggtacgacatcgtaatagcaaacaacagcactaacacaagcgccgccacgtacaattgatacatcaacgcggccgctgaaagtgtaatcaaaacggtcgtaatctgttcagtaccgtaagccaccgatgatagcgcatctgacgatagcagcgccagtgccttgaacttggtgagtgcttgcccaccctcgtccatggtttttaacggtttcccaataactaaccgctttaaataacgccacatgataataactcctttattccaaaataattatcccaaagtaaactgagtcaaagtagattctactactttaccctgccaaatactaccagttaaatgtcgggtgcttcaccgcacccacattttgcgttaacgactaatcctaccgctctaatatggataaatcaatacctttattctagtcgattcacaccctaacagcactaaaaaagcacttactcagccgagtaagtgcttaatgttacgatttgtttacatcataccgcccatacctgggtttggtgcggctggtgcagctggtgcattttcttcaggtttttcagcgacaacggcttcagtcgttaagagaagggctgaaacagaagcggcattttgtaaagcagaacgcgttaccttagttgggtccacgataccagctttgatcatgtcaacccattcatcagttgcggcgttgaaaccaacacctggcttttgttccttcatcttttcaacgataacagagccttctaaaccagcattttcagcgatttggcgaactggttcttccaaagcacgtttaacaatgttgatcccagtttgaacgtcaccagtttccttcaatgcagcaacatctttgataacgttaatcaaagcagtaccaccaccagcaacaaagccttcttcaacggcggcccgagttgcgttcaaagcatcttcaatccggtatttacgttccttcaattcagtttcagtagcggcaccgacacgaacaacggcaaccccaccagctaatttagctaaacgttcttgtaacttttctttgtcaaagtcagaagttgtttcaccgatttggttacggataaattcaacccgttctgagatagcatccttggaaccagcgccttcaacaatggtggtgttatccttagtaaccgtaactttgttggcttgacctaattgatcgatggtcgtgtccttcaattcaaggccaaggtcgtcagtgataaccgtcccgccagttaagatagcgatatcttgtaattgttccttacgccgatcaccaaaaccgggtgccttaacggcgacaacgttaaacgtcccacgcatcttgttcaagactaaggttggtaaagcttcaccagaaatgtcatcagcaatgatcaacaatggcttgccttgttcaacgatggattgtaatagtggtaagatatcttgaatgtttgaaatcttcttatcagtaattaagatatatggattgtcaagatccgcttccatcttatcattatcagtaaccatgtattgtgataagtagccgcggtcgaattgcatcccttcaacaacgtctaagctagtatcaacaccacgtgattcttcaatcgtgataacaccgtcatgaccaactttttccatggcttcggcaatcaatttaccagtttcttcacttgctgaagatacagaagcgatttgcgcaatatcttcttgcgtcttaacttcgtgtgccatagcgtgtaatgagtcaaccgccgtcttagtagcttcttcaatcccacgacgaatgccaacagggttagcaccggccgtaacgttcttcataccttcattaacgattgattgtgttaagaccgttgcagtagtcgtcccatcaccagcgatgtcattagtctttgaagcaacttcagaaactaacttagcacccatgttttcgaaatgatcgtctaattcgatcgccttagcaatcgttacaccatcattagtaattgttggtgaaccatatgattgttccaaaacaacgttgcgacccttaggacctaacgttgacttaactgtgtcagctaattgatcgacaccttttagcatcgctgaacgtgcatcttcagagaactttaattctttagccattatctctattcacctcatgaatttaatttattttaagttgcgcaatttaaatggattagtcttcgattgcaacgatatctttttcgtgcaataccaaatacttagcaccttgatacttgacttcggtaccggcatacttatcgaataatacttgatcgccgaccttcacgctggggtcaacttttgtcccgttatctaaaacacgaccgtcattgacggcaacaaccttaccgctttggggcttttccttagcgttattggcaatgacaataccgccaattgtttgttcttcttcttcttgttgttgcaagataacgcgatctcctaatggttttaacacgtgaatccctccatttattcttttttagcactcctcaacctcaagtgctaattacattgtcaactatatcattttaattcaagattgcaagtgatttgtcaattattagtcaaagaatgtcaaatcgactataatgaatactattgaagtatcaataaatcttaaatcaaacttttaaaaggacgtgacttgatggttaatcgccgccaatcaatctttattcttatcatctactttattatttacgcactaccgagcgtccttgtgactgctttccatcagctaggggcccaagtattcgtgattcaaacggtcgactacttagtcggtgcaatcctactcatctggttggcgagtcgcatgcggacaaaaaacgttgttgaaaaacaaccaagtaactggttcatgacgttcatctggggattgatcggtcttgtcctagtcatcattggtcaagtcatcattttaaaaatgacggctttactgggacagtcaacagcgtcaaccaacacgaccaccctcttaactgttgggcaacaatatcccgctttcttcttagccatcattgtcggtgccccgattatggaagaaatcgtcttccgcaaagttatctttggcaatctaagtgcggttactggtcagattggggcggccttgatttctagtgtgttatttagctttgcacatgcggatggtcactttatcctctatgcctttatcgggttattattctgctggttataccagcacaccggtcggattcaaacatcgatgacggctcacatcctaatgaacgcatcggttgtgttacccacattattaggcttactgcactagtatcattactaggtagcgctaacctagcgtttcaacgttaattttcaccgaatatttatacgttacaatcaatgattcgtgatctaagtatgtggcagattgcaagaaataacttgaacgaatttaatgacgtaaattaagcaagaagatctcgattggtgtatgccaattaagacatttaagtggccgtgaattcaaataccagttgatttgaaccagttggtgatcacttagttcttcaatggcttggcctttgggaataaagcgccgcaaaactcggttacggttctcattactgcctctttcatgcggtgaataggcatgtgcaaaataaacctgtgtaccagttcgccgttcaattgtctgatagttagcgaactctttaccatgatctacggtaagcgtcttgagcttgtcttgaagttgactagctagttcaagtacggcttgagtcatggactgactgtcgcgaccatggagccgtttaacaattgtcaggcgactcttacgctccacaaaagtagccacagcttgacctttacgtttaccagaaagtacggtatcagcttcaaagtggccgaattcctggcgagtttcgactttatgaggccgctcctcaatggagcggccgtgattgaacgtaccacgcttttctttagcacgatgacgacgaattccatgatcaggcaaatcgggcaactgtatatcaagccatccttgatcaatccagttatagaccgtcttgtaggcaatccccaccacatgggcaacttgttcaggggaccacttctggacttgaatcttttcctcgatcaagtgtttaaggtttttagtgagcgaagacttccgcccccgttgactaacctttcgttcaaagtcagtttgcgctagcccagcctggtactcactatttagccggtgaagttcgttaaagatggtggtcttactaaagcctaagtagttagcgatgtatcgcaaggaacgtccttcattatgaagcgtttcaatgacaacacggttctggaatgataaaatagtggtgctcatcaaggtccttctttctaatggattgtgtggtaacaccattaaagaccttgatgggtttttctgtccacttaaatgttcaacttaaattttacaatctgccatgttaaaaaagcttccctgaataattcagagaagcctttttatagccatttaatttcaaagataaagcgagttattaatcttcagtctcattttcatcgtcattaccattgtcacctaattgctgaccgtaatgttcaatgaagtagatcaatgtttgtaattcgttggtcaaatcaacgttctgaacccgtactgtctcaggaacggagattcgtaacggcgtaaagttcatgattcctttgacgtttgcatcaaccaagtcatcggtaattttctgaacaaccgtggttggcaccgttaagatagcaatctcaatctgttgttcgatcaattgctttttgagctccgtcattgggtacactggaaccccactttggactgtattggcaatcgcctcgttgacatcaaatgctgctgaaatgcggacattactgtttttgtgaaaattaaagttcagtagggcgtggcccaaattaccgaccccaattaaagcaacattcgttaaggtgtcttgatttaaaatctttttgaaaaatgcaagtaacgtttcaacatcgtatccataccctcgtttgccgagcgccccaaaatacgagaaatctcgccgaatcgttgctgaatctactttaaccgcctcggacaactcggtcgatgagacccgcttcttatctgcatctagcaagatatttaaatagcggtaataaatcggtaaccgttttgccgttgcccgtggaatttttgtttctgccattcggacgtgtcctcctaattaaaagtttgtgaatttgctgacactattctagcataacgcgtgactttgtgaaataataattacttattattccgaataattgggtcaggccgttacaatatgctacaattatgtcacgaattaaatgtgaaaggagcttaataaagcgtgattttactacaagtacagcaagttatgcggcgttttggcgccgatgtcttgttcgataacgtacaaatggatattcaagaacacgctcgggtggccctcgtcggtcgaaacggggccggaaaatcaaccttacttaaaatgattgccggcgaaacggtaccggacgaaggccagatttcaatgcgcaagggcttaacaatcggttacttggcgcaagaccaaggactggatagtaacaatacgatttgggaagaaatgagtagtgtctttgctgagttacatgccatcgaaaaacggatgcaccagctcgaaaatcaattgagcgaccccgcaatcatgaatgatgagcaggcttatcaacagaccctgaaaacctatgatcagattcaaactgaatttcaacaaaaaaacgggtacggctaccaagctgagattcggggcgtgttgcacggcttccaattcgacgccgatgtgtacgataagtcggtgacggcactatccggtggacaaaagacccagttggccttggccaagttgttacttgaaaaacgggacttgcttatccttgacgaaccgacgaaccacttggacatcgaaactcttacttggttggaaagctatctccagtcttactctggtgcgctgctaatcgttagccatgaccgttatttcttagaccgggtcgttaacgaagtctatgacttatcacaccatgaaatggtgcactacactggcaactacgaccagtttgtgcaagaaaaagcggctcgaatccaagcacaatggaaacattatgaaaagcaacaagcggagatcagcaagcttgaagactttgttaatcgtaacatcgtgcgtgcttctacgacaaaacgggcccaggctcggcgtaagcagttagcaaagatggaccgccttgaccgccctgatagtgacgagaagactgcccactttggctttcatgcggctaaacaaagcggcaacattgtgttgaccgtcaaagatgcagccgtgggctatgatggtcagattctttcggaacccgacaacttgaatattaagaaacatgaagctattgccattgttggaccgaacggtattggaaaatcgactttcctaaagagtattttgggacagattccattcattaaaggccaggccgtttttggcaccaacgtcgttacgggctactacgatcaagagcaacgtaatttaaacgacaaaaaaaccgtcctcggtgaactttgggatgaacatcccactactcctgaaaaagacattcgtaccattttgggcagttttctcttcactggtgaagatgttgataaacccgttcatgccctatctggtggagaacgggcccggttactgttgaccaaacttgccatgcaaaatgacaacttcttaatcttagatgaaccaactaaccacttggatatcgatagccgtgaagttttggaagtcgccctcaacgactttgacggcacccttttattcgtgtcacatgaccgctacttcattaaccaagtcgccacgagtgtcgtagaggtttctccggaaggtacggaactcttcttaggtgattacgactactacatcgacaagaaacaagaacaagctgaaatcgcggctgcggctgctagccaagcggccgaaaaagctgctgaagccggtgcagcggattcaaccagtgccacaactgctgctccccgctccaaaggccagcaaaattaccaagccagcaagcagcaacagcgtgaaaaacgtaagctcgagcgttcagttgccgccctggaagaacagatgactgccttagatgaacaagccacacagattcaaactgaaatggcgcaacctgaagtatcggccgatgttggtaaactacaagacctacaaaaaaaacttgaagccatcaatactcaacaagaacaagttgaaaccgaatggaccgaacaagctgaagctttagaagaattgagctaattttccaatgactcatcagataaaaataatagtcgcctcaagaattaatataattcttgaggcgactattattttgcccctatccgcggcataaatcatgattgaaaggtgccggttaggtgggttcctgttcgtcagcaatgcgcgtccgattccaacctccggggctgggtgacaattgctggaacgtaagccgacgtcgatttgagtcttattctaagccggaaggaacccacttccagctaagaataatttggctactgagcattgtcacccagcccctccagtcgggatgccgctcgaatggctgatgaacggccactgaactcggtacaatttgtcgttggctattttgatactgaaccctttaagtcaaatatcagagtgccttctccactttttcgaaatattcaattattactacggtaattcagaaatagtgagttatcacaagaccttttcaatctgacagttgattgataaaattaacgtttatgaaaaacaacgacaaatccagcaaaagttgagtacgcccctatcagccattcgaacgctatcccgactggaaggcgtttctgacaatgcccagtggtgaaatttcacttagcaagcgtcctgtgcttggttagtgaaaggccagtatttgagacgtggtttttcggctcaaatctgtgcccaccacgttccggcaattggcagaaatgcctggaggtcggtgtaggacgaactaactaagcaagtttacactaacttgaactatttccagcgggcttaagctggtcatttttgattctaggaatcatcctcttttaatcataattaatgaaaagatactaaaacgggtgtgaaaaggactgacttttcacacccgtttataactgcttcattacttcaacatacctggcatccaatcaaattctaagcttggatcggcattcagcgccgcgtcgccgaattggtgatgctgatattgaacatagcccgcagcaccaatcatggcaccattatcaccgcataactttagaggcgctaagattagttcggtgtcaggaaaagcggttggtaaatcttgttgtaaccgttcacgtagcccctgattagctgcaacgccaccggctaagactaattgcttaactggatattgtttgaggactcgtaacgttttactcatcagaacatcaaccacgctggcctgaaagctagccgctaaatcgttcttatccagagtcgcgccaatttgatctgcgtgatggaccgtattgatgaacgcactcttcagcccactaaaactaaaatcgtaattatcttcatcaatcattgctcgcggaaatttgaaagtgtcgtgacctgcatgtgccatctcgtcaatgactttacctgccggatatggaacacccaatacccgaccgattttatcataagcttcaccagccgcatcgtcacgtgtctcaccaataatctcaaactgcccatctgcttgcatgtagaccaattcagtatgaccgccagaaactaatagtgccattagcggaaattcgaatggcttaacaaaccgagcggcataaatgtgcccggccatatggttaactggaatcagcggtaattggtgcgcgtatgccactgtcttagctgcattaacaccgactaacagtgcccccactagaccggggccatacgtcacggcaacagcatcaaggtcagcatacgtcacgtgtgcctcttgaagtgcggcttcaatacaaattgtaatttgttcaatatgatgacggctggcaacttcaggaaccacgccaccaaaccttttgtgactattaatctgcgttgcaatcacgttggataaaatctcatggccatctttgatcactgccacactagtctcgtcacaactggactcaaacgctaaaatcaagttttgtttttccacggttcccatccttttaattaatcattttacgcatgatccacgcatcttcttcgggatcatgataatattccttacgcgtggcaatctggtcaaagccgcattgctgatacaagcgctgggcggcgagattactagcccggacttctaggaatacggaccctgccgataattgtgctaagcaggctgttaataaccaccgcgcatgcccttgacgctgataggccggatcaattgcaatattcgtaatttcggtctcatcaagcactgttgagcggctgacaaacccgatcagttcatcctgccaccgtaataaatcatagtgtaccgttggtaacgccatgtccgccgcaaacgtcgcttgccgccaaggtgcgccaccgggatatgctaatgtcgctaactggtaacaaacttggacggcccgacccgcgtcaagctgcgtactggcgacaagctgtcgttcagtcatccgtagctaccggaatacgataagtcatatcaatagcatcttcatggtcgccaaaatagtaccgtttcttgataccagtcttttcaaaccctaaatcgcggtaaagttgttgcgcaatcgtattactgtaacgaacctcaagggtcaccgtttggtaatgcaacttacgcgcccgcttcatcatgacttgcatcataaaatggcctagtccttggccttgaacatcaggatgtacagcaatattggtgatatgtgcatcttggcggcgatcatcaaagacacaaccacaaaaagcgacgaggcgatcttcatgacgcatcacaatatagaaacgaccgctctgtcggcgaagttccgtcttaaacgcattttcatcccacggtgtctgtcccgcatatacggcccgttcaatggctagcatctcgggcacatcggtaatcagtgcgcgtgagacatagtaattgacttcgcccactttaacgatgtgattttgaatggccaatacacgttggcggcgttgattgccaccggtggtcattttttgaaagtactccttaaattttctcaacatagggcgcatgttccttttctgggtgcttggcttgccaatcacgttcagcttgcgttaaacgcaaatagttcggcacaaagttatgaatttcactcacgggtgtcagcgttcgacccatcaaacctagtactacggcttggggcaagtcaagttgtggggctgcacgaacgaactgcttggctaacgattgctgcaaagcatccgcatattgatcgacatccgcgccgacaaaggtaattggttcatcataactagctaatcgttggctccactcggccacactgatatgttgatcagcgataacggcaactgggcgctggttcttaatccgatataacccggcaaagatgttgtcacgacgcgcatcaaataacggcgccactaattggccttccgtcacaatgttgccagctaacacggccaaacttgatacaccaactaaagctttatctaatgtaaaggcaagtgttttagcagtcgtcacgccaatacgcaaacccgtatacgaccctggtccggcagcaacgacgatccggtctaaatcagctggtgccaatttagcttgagccatggcttgttcaataatcggtaataatgtactactgtggttacggccaacattagtggtcgttgtggccaagatctgggtatcttctaataccgcgacactcaatggccgattcgaagtatcaatcgccaacaacttcataattttaaaaaactcctcattttgaattacttcacatatcttatcataatttacttactttgaaagctttacggtagtaaccaaccaattcaatccagaaacaatcaacaactatcctgaccagtttccactcatacttaccaatcactgaattgaaaaccgaatgtaaatattatttacataacttatacatatacttcactaatccttgtccgcacatttacaataccttgttatgctacacaagtaactaaaattacttggaggtaattggaaactatgtcaaaagttagtaagtcattattaggtctttcattcatttcggttttaggtttaggactcgcaggttgcgctagcggaaccagtgctaaatctggtggtagcagtacggatagcagcaaaaccatcacggtggtcttctatcctaacgaatcagccaagagttttgctggttcccgtacggccattaagcaagcagttgaaaaggcaacgggtaagacggttaaattacaaaccacgaccgactataacgttgcgattcaagcaattgcatccggcaaagctcaagtcgcatacatgggggctaacggttatatccaagcacaccacaagagcaaagatgttgtaccttttgccgcacaatctgatgctaaaggtaccttgaaagacgctacttataactcctacttaatggtacaacaaaaagatgccaaaaagtatgaagaaaacggtaagtacagtattaagaacgtcaaaggcaagaagatgtcttatgtttccaacagttcaacttcaggcttcttagtaccaacggctgaaatctcacgtgaattcaacatcaaaaccgctgaccaagataaattaactcaaagcggatcattctttagtaaagtgctctatggtggctctcatcagggttccgcggtcaacttaatcaagggggatgcggatgtcgctgcctttgatgatgctgatttaatgccatacttaaacgttaccaagggatcatgggacaaggtcggctcaactttcactgttaaggataacgccgaagcgccatttacaagtttagccggcaagtcggtcgttaacattgccatgatgcctgttcaacaaggcccatgggtatacaataccaaggccctcagcaaggatgatcaaaagaagatcgccactgagttcacgtcgaagtcctttgcccaaaacaaaaagatcttctctgaaccaaatgcgaagacaccaatgatgttccctaagaaatcagaaaagtccaaattagttaatgttaccgacaagtggtacgcgccaacgcataagttagtaggttactaaaccacgtaccattagttcacaatgaaaggatttgccaatgctcaaggttattcagctagataaaacatatggttccaataagcattcgctcaaagcagtcaacttcacagctaaaccgggcgaagtaactgccatcatcggcccgtctggtgctggtaaaacaactattttacggagtatcaatcagttgatccgcgatgatagtggtcaaattttgctcgatgacactgacattcgtcaagcgaacaaagctgaattacgcaaagttcgtcatcatatcggcatgattttccaaaactacaatctgatcagtccgttaacggcccttgaaaatgttctgcatggccgcttaggcgctaaatcaacagttgctggcatgctcggcctttacagtagcgccgaaaaacaagaggcgctacaactactcgacgaagtagggttaaaagaatacgcctaccaacgttgcgatcaattaagtggtggccaacaacaacgggtcgggatcgcacgggcattaatgcaacatcctaagatgattttatgtgatgaaccgattgcttccctagatcccaaatcaacgaccattgtcatggacattctacggcgattggcaaaggaaaaacaactgattatcctcattaatctacatcaggtcgatatcgcaatggcgtacaccgaccatatcgtcggcattaacagcggggccatcgttttcgaaggcgccactaatgaagttgacgacgcggtcttacaacacatttatcgccaacctgaccaatcaacggcggtggctgccaatgaaaactaatccaatgacaccgcaacgcttttttcggcaacgtcggttgcgattatcagttgttttgctcattttaattggcatctacgtcttatccatggccctcgttaattttcaggcgtgggcttcgatcagtaagattccagcgggcttaatgtggttgtttaccaactttattccgacaagtcgttcgatttcttatctgggaccgattctttatcagctgtggcggaccttgctcgtggcaatttcatcaaccatggtcgctagtctcttcgccctgatctttgcgattctcggtgctaagacgaccaccccaacacctgtcctccgctggattattcgttttggtgcttcactcttacgtaatattccggtggtcgcttgggcgatgattcttctgttttcttttaaacagagtgactttacgggcttcttggcactgttctttatgacgctaggctatctaacacgggcctttattgaaactattgaggacctcgatgctgaaaagcttcaagcactgcaagccgttggcgccaactatttccaatgtgtcttctgtggggtgttacccgaagccgctagtaccttgactagttggattctctacatgattgaaaacaacttacgggacgcaaccttggtcggactcttgacgggtacgggtgttggttttctctttgactactattttaaggcgttccgctatgacgctgctggtctaattgttttgttaattgcgattttagtcattgttttagaattgacatctaatcgaattcggagggcaattgcatgattgaaaacagtcaacccaaaacacaagtacttcaaccgtcagcaccaccaacccggtcgatttcgttggtgactcggccccgcaaaatcctgcgagccgttatgattggcctaacgcttatcagtgtctattcattagtcacactcaataatgccaacctgaacatcattgacgctttgcatagcttaggtctcaacctgaatgctatgttcttacaccctagcgttggtcaagacacactggggcaactcttacgggccctaatgactagtgtttcattagcaatgttgacgactttgttaggagcgctaatcgccttcttcattgccgtcggtgctgcccgtaacttagcacccagttggttagctactagtattaaagcagtcatggcctttattcgtgccattccaacgattttatgggtgttaatttactccgtagtcatgggattaggtgctagtgccgccgtggtcggcttgaccttccacagtgtagcgtacttggttaaggcttattctgaaagtattgaagaaacctcacaagatacgattgaagcgttaaaggcgagtggcgcgggtttttggccgattgtttttcaggccattctcccgtcaatcattccagcacttcttagctggacgttcatccggtttgaaattaactttgccaatgcggtcgccgttggtgctgcagccggtgctgacgatatcggttactacctcttcatggctggcagtttctacttcgatttccatgaagttggtttgattgtctacctactcttgggtgtcgcaatcgtgctcgaactggtttctatgcggttacgtggccactacttaaagaacaactaagtaaattcaaaggagttttcatcaatgacaattaaagcagtaatttttgactgggccggcacgaccattgactatggcagccgggcgcccatcgtggctttccaaaaagcctttgccaacgttggtattcaaatctctgaagctgagattcgccaagatatgggactagataagtacacccatatccataaaatcatggatttaccggccgttcaaaacgactggcaggcgcgtttccaagtcttaccgactgaagacgactgcaatcaaatctttagcaacttcaaggcaatcttgcttagctccctgactgaattcggacaattaaagcccggcatgtcagctgtaattgactatttgaccgctcacaatatcagctatggcacgaccaccggctatgacgctgaaatgttagccctggtcttaccgatcgcagctaagcaaggctatcgtcccgccgtcaacatcacttcagaacaaactggcggtgttggtcgaccagcgccggcaatgcttgcgttagcagctgaacagctcacagtcaccgatccaacgaccgtcatgaaaattggggattccgttaatgatatcttagaaggcaacaacgccgacgcagtctctgtagggattattgatggtagcaacatcatgggactttcggagttagccttcaacgcccttagccccgccgaacaagctgaacgacgagcccacgtcactgccgcttatcaacgcgctggtgccgattacattttacaatcgatggctgaattaccggcattgcttgatcaaatcaatcaaccggttgccactgatcattagcagacaaggagcccgatttttatgaaacaaccttatttactcctaacacccggtccactcagtacgactgccagtgttaaggacgcaatgcaaattgattattgtacttgggatagtgactatcggcacgtcaccgaaaccattcggcaacaaatcttagctatggcccaagccaatccagaaaactatacgaccgtcctactacaaggaagcggcagttttggtgttgaggccaccattggcacagcagtaccacggaccgatgcaactttaatgattgccattaacggcgcatatgggcatcggatcagtcaaattgcagaatattacgatattccacatatcgacgttgtgttcaacgaagatgaagccgtcgatccggttcggattgaagcaaccttagctgatcatccggagattacccacttcgcaaccgttcatagcgaaacgacaactgggattctcaacccaatcgaagccttaatgcctatcatgcatgaacacgggatcgtaacgatcatcgatgccatgtccagtttaggtggcgtcccgattagcattgatgaattggattgtgactacttgattagtagtgccaacaagtgtgtgcaaggcgtgcccggttttgcgttcattattgcaaaacaagcgaccttggcccacactgctgacaacactcgttcactttgtctagatctctacgaccaatggcaagccatgaccaagcaaccaggaaaatggcgcttcacttcgccaacccacgtggtacatgcctttgcgcaagcactcattgaattgcaagcagaaggcggcgtgacaccacgctaccaacgttaccatgctagtcaacaactccttagcgacggcttacaagcgctaggttttgaattagtgattgatccagccattcaagggcccatcattacgtcattcaaatacccgaacgtcgactttgattttgctgacttctatcagttcatcaagcaacgcggcttcgtcatttatcctgggaaggtttcaaatatccctagcttcagaattggtaccatcggtgatgttgatacaactgatattcaacgactcttaacaattatcggtgattatcaacaacttcaccgctaactgcattgatcaatctaaaaggtgcgtgccaaggactcaatcctgacatgcaccttttttgacgaccacaaaagcggctttgaaatctattgacgagatttcaaagccgctttcaattatcagctaaccgatactagtcacgatcatcgtagccattgggatgcttctgcgtccaagcccacgctgtttcaataatatcgttaacattgtcataatttggttgccaacctagcacgtcacgcgccttatcactcgccgcaaccaatgagtctggatcaccaggccgccgtggtgctagcttagctggaattggttgcccggtaacttcacgagcagccgctaacatttgtttgttagagaaaccagttgaagaacccaggttaaaggcattgctgtcatttcctgcagccaagtacttcaaagccaagatatgtgcatcagctaagtcgacaacatgcacatagtcacgcacattcgtcccatccggcgtattatagtcatcgccgaagattttaagttcatcgcgttttccttgcgcaacttgtaaaatgattggaaccagatgtgtttcggggccatgatcttcgccaatactgccatctggcttggcacccgcaacgttaaagtaacgtaacgcgacaaacttaatgccataggcgacgtccgcccagtgcataatctgttccatcattaacttgctggcgccatacgggttgattggtaactgtggatcagtttctttaattggaatctgcttaggtgtcccataagtagcggccgttgatgagaagacgatttgcttcacattatgggcctgcatcgtttcaagtaacgtgatcatcccaccagtattgttatcaaagtacttcagtggcttactcattgattctggtacgattgaaaaggcggcaaaatgcacgacagcttcaatatcctcagtatcaaaaacgtgattcaaaaaatccgcatcccgcaaatcaccctgataaaacttggccgccgaattaacagcagcacggtgtcccgtgaccaaattatcaacgaccacgacgtccgtaccgtgttctactaaccgatcaaccatgtgagaaccaatgtagccagctccccctaaaactaaaattgacataatgaacctcccctgtatggatgtattaatcatagcatactgaatcgctagcgactctaataaaaacgtgcgttctaatcgaccaagtcgctcatgaccacatcattaacacactagtgtaaataccaacccagcaaattactgaatcggctctggtaaagtccgccattgaatcgtgacctcacaacacttctcatcatcaacttcgatcaaatgactcgtcgtgacctgatcggccacttcgctcggtaagatgttcgcatgagcagtcaccgtttgcccgtacttgacttcattttcatagcgaacgtcaacgtgaactaaatcatgttgaagcaagaacgtcgcgggtagcgtatctacgagccaatcaaaatagtgtgcattattaacatgccggttgggatcaatgtcaaagaagcggacatggtacggcttcgtaatcgttgtatcggtcgcttcaaaactaatcggtcgtggcaagcgcggaatgcgcttgacgacttccgactgatacggcgcgaccagttctggtaaaatttttacgattcgccgggtcgtttgactcatcatgacccagatactcgtaatataggccaactgttgaccatctgcgtcccgaatccaaaattcacggtaagcaaaatatggattataagcactaccccgaacggcaatcgtaacgacttcgtcttggcggggcatccgtgtaatatcgatggcatattgcgtgacgacccaaccgacaccatggctttgcaccatttccgtcgttaaaccaagggcgtcgctttgatcctctgatgccagtacggcaatatcaattaatgtcgttaaggttgcgcgaccagtgcggtcacattcataatacgtaatccggtgctgttcactgtaaagactcgcatttgcgcctaaagttgccattcatcaagactcctcatcgttggtatttagttcatgaaattgattataaacgctttgccggggaatatttcgtcgcttcgcaatcgtcttaatggccacgttgggcttatctccggctgcaatcaacgcttcgacttgggctttgactggcaactgtgccaattcatccgttgtttctggttcatccttatccggattaccaccgatcaaaaggacaaattcgccctttaactgatgatcctgcgcccacgtcaccatttcagccaaggttccacgcgcgaattcctcgtaacgcttagtcaattcccggcacgccacaattggccgcgtcccttcacagacggtcgctaggagggtcaaggtcttggcaacacggaatggcgattcgtacaagaccactgtttcatgtcgccgagccaatttagccaaatcagctttttgttcattcttcttacgcggtaaaaagccgtagaaataaaatggctgtggcactaggccagaagcaatcagcgcagtcaggccggcattggcacctggtagtggcacgactggaatattcgcggcaatgcaggctgccacaagttctttgccgggatcactgattgacggcatccccgcatcgctaacttgtgctaagttaacgcccgtctgtaatttttcaattaactggggaatccgttcttgggtgttatgttcatgaaagctaatttgtttcgttgtaatttcaaaatgattcaataacttttgggtattccgggtatcttctgcggcaattaggtcaaccgttttaagcgtcgccactgcccgataagtcatatcctgtaagttgccaattggcgtcggtactaagtacaaggtcccgatacccgcatgatctgcaaaactttgttgtgtttccaaaacgtcctcctaacaatcctctcgaccgtgacttgttcctatgagtgactcgtggtgaaaagcacaaaaagtctgggactactcccagactttttcgactatgcgcgttcacgttcaccataaatgacttccaaacaaaaaacgcaggattcgtcatcgtcacgccgtttgccgtaaaactggttgcagacgtggaagccctcatcatagagtttttccaagttttgccgtgactttgagagcgtggtcgtgctagccgcttttttcggcaattcattttcaatttcgaccatgtgttcacgtaaatgttcattttcaatgaccaattccgcgtttttctctaacaccgttgtcatatcggcgcgtaacttagccattttgtctagcatttgttgcatctgttgttccatctcaccgaaactatcgtataaatcacgcttatccacgcgctcaccctcgttttcctttatttaagcgtttgtttgaaaaatcggccataactttaacgttaagccttctaagacattttgaaaactaatattgctagctagctggcgcttggccgttaaagctagttctgtcgccgcaatcaactgctcatcgctgacttcagccgttaacccggccaattctttttggtactgaccaaaggttaacgctgtcgttgccacctcaaaatttaattgcaatagatcttggaacaaggccgcaattaaatccaacataaccagctgatgatcagcgtccttagccaaaccaactaaattgacctgcacagccacaaaactccgtgggtcacccttaacagcctggtcaaaccaccgccacaatgcttgcgcagcttgtggtaaccaatcatccgctagcaacgcctgcgcctgggtcacgctatttgtcaggccccgtaacatctgtgcttggtttggcgcaatcccggcctgttcaaacgtctgctgtaacgcctgcgcatttaatggtgggaattcgatcacctgggttcgtgaaataatcgttggtagcatcagttgcttattagtcgttaataacaaggccgtgacgttaccacttggctcctcaataaacttcaataagctattggcagcactcgctgtcatcttctccgcatcattaatgatgaacagtttccggttaccttcgaccgcactcttagagaattcagcttttaagtaacgaacctgatcaacgtgaattcgctgaccctcgggagccactgtcacaatatcagggtgcgacccattagcaatccggacgcactcctcacaagtgccatctggttcaccatcattaatatgcaggcagaacaaccgttgcgcaatccaatgggccagttctggttgtccagcgccttccatccccgcgaataagtacgcgtgggccagatggttctgggcgatgatgtgtttaaatgccgctaataagcggggctgtttcgccgctaacgtttgcgcaaatgactcggttgttgccattaataatcatccttcattaaaattggtgaaattgttcaattggtagaacaaagaccgtggcgccaccgacttgaacttcaactggataggcagctgcgccatccatcgtcacgtctagattgactggtggtgtcataaactgttcccgcgcatgactcgtttctttaatcatggctaaaacttcatccacacggtcatcatcaataccgatcataaaagtggtattacctgaacgtaggaagccccccgtcgttgagagcttcgtggcccgaacattggcttcaatgaactggctgctcaaccggttactgtccttatcttgaacgattgcaataattaatttcattggtcttcccctcccttggatgccacataagtcggtaactgtgacgccataatctctaaggcctgcgtcacaacttggtccaatggctgacttgcatcgacgcgcttgatacggtcaggatgatcagccagtaatctcaaatacgctgcttgcacccggtgatgaaaacttaaggcttccacgtccaagcgattaatttcattttggcgatgttgttgaatgcggtttaatccaacggcagcatctacgtcaaaatacaacgttaaatctgcggttaaccccgcggtcgcgaactgattcatatcataaaccgcttgttccccaataccacgaccggccccctgataagcgaccgagctatcgatgtagcgatcacacaagacaagttggtcgttctgcaatgctggttgaatggtttggacgatatgttgtcgccgtgctgccgcatagagtaacgcttccgtacggtcgtccatcgccgtattatgacggtctaaaatgatttttcgaattgcttctgagatttgattcccgcccggttcacgcgtcacaactaagcgatcccctaattgtggctgtaatttggccacaatcgcgtttaaagctgacgttttgccggcaccgtctggcccttcaaaagtaactaattttcctgtcaacattcccaatcccatctattttcttatatgtagcaattgtacttgatttttgagtacctgtctaatacggttaccactagtgagggtactttttcacgatttttacgtgggtcggctactaccaattgtggttttgatgatttattcggtgaattgctaaaaagttattaggtagtactacccacgattgataaataccgattttagtttgttattcattagtagatacacatcttctattccaattgccgcacctagcatgtcttaatcacaatgcatgacagattaactggtaaaataatgctagggttctaaatcaaaaacgcacgccgtagatttacaaaaatcaacgacgtgcgtctttattttgaaacaagttatctcttaaatcactaacagtctatttatcaatgaccgagcgctgaatcgtctgcccatgaacttgacgtaaacgtgcttcacgatacagatataaatacttagcacgcgctaaggcggtctgcgtaactagttcactcgtattattatcatagaccgcttcttggttctgcttcgcacggtcccagtccaacttagcggcattcagggtcgacaacaactgttcatcaaaaacttccttgggatgcttgatcttctgtttacgtttaaacatggtggcacctccaattacatttcttggcgaccttcaacggctttgaataaggtcatttcatccgcatattgaatatcactaccaaccgacaagccgtgcgccaatcgggtcactttgattcccgccggcttaactaaccgcgagatgtacatcgctgttgcttcaccttcaggcgtagcgttggtggcaataatgacttccttgatggcttcattttgctgtagccgtttcaataaactggcaatgttgatatcttccggacctttgccatcaatgggtgacaataccccatgtaagacgtgatacagcccgttgtattccttaatcttttccattgccatgacatccttggcctcttcaacaaccagaacggtgctttgatcacgcgacttatccttacaaatcacacacggatcatcttcggtgatattaccgcaaatactacaaaaatgcaggtcccgtttggccgcaatcagcgacttagcgaactcggtgacgtcatcaccgttcatatcaattgtataaaacgccagccgcgtcgcagtcttgccaccaatgccgggcaacttcatataactatcaatcaacttagcaattggttctggatactgcatgtacttacctcgtttttactgtaatcccttagtatattttcccatcgtactttgtgtctgttcatcgaccttagtcaacgcgtcgttcaccgcagcaacgactaagtcctgtaacatatccacatcatcaggatcaacagcatcagggttaatcgtaatatccttcatcttcttatcaccagtaaaagtgactttgaccatgtcgtctggcgccgcacccgtaaaggtttgttcatttaaagccgcttgttcggctgtcatttgcgcctgcatcttcttcatttgtttcatcatactttgcatattgcccattccacgcatcataattatcagttcctttcgtctttagtccggctgtacttcaactaaatcaccgaacatgttcttagcttcttcaacgaccggttctttggccggtgcttgttgctctgatgttgcacctcctggctggtgagtggccaaataatccttacgaatttgtggccactgttctttaggcacacagacaatcttgggtgcctgtcccatcagccgatccaaaccatttccgagtgcatcgatcaaggtctggtcatcaatcgctttttgataaacaaacgcatagtcaaacgcaaccacaacaccttctgaactggccgcaactggttgggccacgtgcattagggcccgctgcgtcacactcaaaatgttcatcaaatcagtccaaacatcgcgcaccttaatgagatcattcttcgttgccgctcccagaataggataaatctgactgacattaaccttcttaacaaccgggccattactcgaccgcggcttagccggtgcgggtttagtgacactaccaccttgagaacgtaacgttttgacctcgctttgcaactgttcaacttgttgtgccagtttatgcacagtgggatcttcaggattgaccgttgccgcagctaccggttgaacggccgcttgaccatccaactgagctaacttgaccgtcaacacttctaaataaacgtcggggtgcgtcgtgaaccgcatttgttgttgaatatcgttcaacgtcttgaccatttgatacaggacttcagcatcgatttgcttggcaaatgcttcaaattgttgatcatcctcgcccatcgccacactatcgaccatttcaggggcctgttgatagagtaacacgtcacgcgtataactgatcaaatcttcaatgaaacggttcgcatctttaccttcttgtaagatttgtcgcatcgtctctagtgccggcttcgtatcatggtcggtgacctcactgacatagttagccagcaactgcttggtcacacttcccgtcaccattaacgcatcatccaacgtaaccgtgttatctccaaacgaaattacttgatccagaatacttaaagcatcccgcattccaccttcagcagccgctgcaatgacgcgtagcgctttttcatcataggtcacatccttctcattgaggatgtacaccatccgatcatagctatccttagctgtaatccgccgaaaatcaaaccgttgcgtccgtgaaataatcgttaatggaatcttatggggctccgttgtcgctaagataaatataacgttagccgggggttcttctagcgttttgagcaacgcattaaacgcgccagtcgataacatatgaacttcatcaataatgtagactttatagtccgcttgcgttggagcatacttcgctttgtcccgaatatcacgaatctcttccacgccattattagaagccgcatcaatttcgatgacatcatttagttgccccttggtaatcgccgtacaagtctcacattcattgcaaggttccccatcaacaagatggtgacagttaattgccttagcaaaaatctttgctgccgacgttttcccagttccccggggaccggtaaacagatacgcatgactcgtctggtgggtcataatggcattttttagtgtctgggtaatcatctgttgcccgacaatctcatcaaagcgttggggacgccaaacccgatatagtgcccgatacatgcgattcttcctttcttacatcagtcatactttggttatcattacttattataagccattgtttaaacgtcctgaacagttagcttcctggttgtgctgcttccactaacgatcagtgtcggttatgcaaattaagcatctaagcgcacttgccaacgagtcgatgcccaggcctttaaccacctttgttaggcgtttggttattccttcaacaagcagtggctttaactatcagcctgaaaagcatcacccaaataacgtattactactataataataggtaaataaaaataaaccaacctatcagcacgttcaaaactagcactcaatatttaatttaaataaaaagctctcaaccgaatggctaagagctgttacatttcataaaaacaaaaggcacaagatgaagcaaacttagtgctgcttccttccggacctgacacgattcgtaaatccacccttgccttttggccttgcggcaaatactataatacatgatttgcgccacaattaccagccatcggcctaatttttttcagcagcttcacgtcgtgcttttttagccgcctttttccgtttacgaatcccacggaagaagttttccaacatctcgccggccggacgtgccaagatgcgttcatgaaccgttacttgatgatttaaccgggtatcatccatcacctgatacaaactacgaacggcgccagccttgggatcacgggcaccaaagtagagttcaggtagccgtgcattaataatagccccactacacatcaaacatggttccaaggtgacatatagctgacaatcggctaatcgccaactatgcaaatattcgcaagcttcctgaatcgcaataatttccgcgtgcatcgttgcatcctgaccatgctcccgtaaattgtgaccacggccaataatttcaccctggtgaacgatcacggccccaatcggcacttcgccaattaagtaggccatccgcgcttcatgtaatgcttcttgcatccagtcttccgctgttggttccgtcacgactatccctcctttacactttgtaggatgtaataccctttgtccttcttaatcacctgacaattaccaaaggtcgtttgcatcaatttcttcgcagatggtgcgccctgctttttctgtaaaacgacggtgagtgttccaccaacgactagccgtgaaacggcccccgttaacatcgcatccaccactgccttacctgcgcgcaccggtgggttggtgacaatcgccgcgtaattagtcgcggtcacttgttgatagacatcagacgtaaaaatattggtattcgtaatttggttcaaagcaacatttttacgcgctaagcttagcgctaactcgttcacatcgaccatatcaaccgttcgttcgggtgattgatacgcgagcgccatcccaatgggaccatatccggttcccaaatctagcattgggcccgctggcaaatcagttggatcaaacgctgcaagtagtgttcgtgagccgtaatccacggtacgcttggagaagacaccgttgtccgtcgtaaatttaaacgagtgattaaaaatttcaaaattccattgcttttcatcatgcacaatatccggattgtgtgtataataatagttggtcatatttattttcctctaaatttctggtctatatctatgataactgattcagcgagtgaaccacaaataatttaaaaaactttttagtcggttaaaagctgacactaacacaacatctagggcttgtgatttttaccacaccctagatgttgtgttttttgattgtttttttcaccacatgttgtatactaaatttatcagaaaaacgagttaggatgatgaaaaatgaaaaaagttactgtatttactaaaaacaactgcatgcaatgcaagatgactaagaagttcctcacggcgcacaatattgcctttgaagagaagaacatcaatacgaatcctgaatacgtcgattacctgaagaatcaaggtttccatgctgttccggtcgttgaaatcaatggcgaagacagcattgccggcttccgtcctgatgctttaaaacaattagctgtttagtttgttcacgcttttttgcgtggttacatagctggtttaccctttaaaatatgataaacgacccacaatcatcaacctactgattgtgggtcgtcgattttgccagccacaattatactgatagaaagaggattccttatgaccttaaaagatttaaaagacgtcacgtattacgacttaaataatgagatcaatattcccgttaacaatcagattccgctcaacaaggatcaggaggcacttgccgctttccttgaacaaaatgttgaaccgaacacgatgaaatttgatagtcttaaggcgcgctttgactacctacgtgaacacgactatttggaaacccctgccattgataagtatgattttagctttatcgaaaaactttacgattacttgcggtcgcaagacttccacttcaagacgtttatggcggcttacaaattttatgcccaatacgccttaaagacggatgatggcgactattacttggaaaactttattgaccgtgtggcaatgaacgccctctactttgctgatggtaatgaagacttggcgatggacctggccgacgaaatcgttcaccaacgttatcaaccagccacccccagttttctcaatgctggccgggcccggcgtggtgaattgatttcttgcttcttgattcaatcgaccgatgatatgaactcaatcggccggacgattaactccgcgttacaactttctcggatcggtggcggggtcggtattaacctcagcaacttacggggtgccggtgatccaatcaagcatatcgatggcgctgctagtggggtcgtacccgtcatgaaattattagaagacagtttctcctactctaaccaattaggtcaacgtcaaggtgccggggtcgtttaccttagtgtctttcatccagatattattgcctttctttctgctaagaaggaaaacgccgacgaaaagattcggctcaagacgctttcactcggtgtcaccgtacccgacaagttttacgagttgatcaaggctgacgctgatatgtatctcttcagtccttacggcgttgaacgcgaatacggggtaccgttctcatatgtcgatatcaccaaagaatacgacaatatggttaagaacccgaacatccgtaaaactaagatcaaggcgcgtgaccttgaaaatgaaatcagcaagttacaacaagaatctggctacccatacgtcgtcaacattgataccgcgaaccgcgaaaatcctatcgacggtaaaattgtgatgagtaacttgtgctcagaagtgatgcaagtgcaaaccccatcattaattgatgaccaacaacagtatgagaagttgggaactgatattagttgtaaccttggttcgactaacattgttaacttaatgacctctccagactttggacattctgttgaagccatggtgcgcgcgttaacttttgttactgaccactctaacgtcgacgtcgttccttccatccaaaaagggaaccgtcaagcccataccattgggttaggtgccatggggctccatgcctttttcgcgaagaatcagatggaatacggcagtaaagaagccgttgactttaccaatatctacttcttactcttaaactactggaccttaaaagcttctaacgaaattgcgcgtgaacgtcacgaaaccttcgttaattttgaaaaatccaagtatgccgatggttcttactttgacaagtacaccacccaagattggcaaccaaaatatgacaagaccgctgcactgtttgacagtatcttcattccaaccaaagctgattgggaagccctcaaagaagccgttatgcgtgatggtctctatcatcaaaaccggatggctgtcgccccaaatgggtcaatctcgtacatcaacgatacgactgccagcctacacccaatcatcaaccgggtcgaagaacgacaagaaaagaaaattggtaagatttattatcccgctccttacctatctaatgatacaattaactattataagtcagcatacgatactgatatgcgtaaagttatcgatgtctatgcggctgctcaacaacacgttgaccaaggaatgagcttgaccctcttcatgcggtcaactattccagctggcttatacgaatggaaagatggtcgcactgataagatgaccacgcgggacttaaacattttacggaactacgcctaccgcaaagggatcaaatcgatttattatattcggacctttacggacgacgatggcgaagtcggtgttaacgaatgtgaaagctgcgtaatttagtatcttagatctctaggaggataacaaatggcaacagacttggcttactaccaaaaactgctcagtaatggcaactataaggcaattaactgggatcgagtttcagatgcaattgataaaagtacttgggaaaagttaaccgaacaattttggttagacacccggattccagtttccaacgacatggcagactggcgtgaattagatgatgatcaccggtgggtcgtgggacacgttttcggcggtttgacgctgctggatacgttacaatcacaagacggtctgcaagcacttcgccgcaacgtcttaacctcacatgaaacggccgtattgaataacatccaattcatggaatctgttcatgcaaagagttattcaacaatttttgaaacattgaatacgccggacgaaattaatgaaatttttgactggagtgacagtgaagaattcttgcaagcaaaagcccaatggatctacaagctttacgataacatcgacgaagatccattgaagcaaaaagttgcgaacgtctttttggaaactttcctgttctattctggtttctatacgccactgtactacttggggcacaatcaattgccaaacgttgccgaaatcattaaattgattttgcgggacgaaagtgtccatggcacttacattggttataagttccaattaggcttcaaagaccgttctgaaaagcagcaggcagaatttaaagactggatgttcgatttcttatacaaactctatgagaatgaagaaaactacattcatttagtttacgatcaaattggttggtctgatgaagtcttaacttttagtcgttataacgccaacaaagccttgatgaatctcggccaagatgccctcttcccagatactgcggaagacgttaacccggtcgtcatgaacgggatttcaacggggacttctaaccatgacttcttctcacaagttgggaatggttaccgcttgggtcaagttgaagcaatgcaagacaccgactacgatattggtaatccagacgattaatcaacacgttagttcacaaaaatgcggcgcctatccgggccgcatttttgctagaaaattttatcttgggggtagtttagaatggcaattcataatatctgtgttttttgtgggtctaattctggtttagatcccgcatttagtgagaaaacggtggcactcggtcaatacttggccgctaatgattaccaactcgtctatggcggtggcgaccatggtttaatggggaaagtcgccaaagcaactatggatgctggtggccgcgttatcgggatcatcccgcattttctggtcgcaagagaacttgcatttaaggacgtcacgacttttatcgaaacgcgcacgatgaccgaacgcaaggaaaagatgcttcacctcgctgacgcctttatcgttttacctggcgggtttggcacctttgaagaattcttacaaatgttatcttggagtcaaatggatattcaccaaaagccgattgcgctctacaacatcgacggcttctacgacgatctagtcgccatgctacaaaagaccgccgacttagggtttgcccccgaggctaacctcgacctattcattaatgggcatgatcttgatgaaattttcgctggtttccatgatttcaaacatgtgttaccgcctaagtatacgaactaaattctttcaataatacatgacttcaactagctttaagacgctattactaccgcaaaatctacagtagtaatagcgtctttttcaataatctattcaagatcatctcctgtgaatccaagcacctgaatgaccttccatacaaaccagatactaatttcacctttttcgcatacagatttccccagatcacatttaagcttgagcttcatacgctttggctaatgttccgaacgattaacactcagtaccgcgattaatcaggtatcaagctctcagtaaccggatatctcccatgactcaatcccaaaattgccaactagcccgcggcccttctgtctgcttatgatacttaaaataggttgagccagcctgttcgcgcatgacgagtggaatttgatcacggcgcacgatgcgaactgcactcacatatgatcccttgtgcttaactagtacccaccgagctgtcttggtcggttgccccgaatagaacttaagccaactccccttgccaaacggatcatctgacacatacgtatcagtcattcccgtaactttagtcggcaatacgccatatcccagttttgtcgtcagaaatggattaacgcggtcaatagctgcaatttgattacgatgctcccagctcaataagacaatcaaaccacctaataagacaatcaaactaaccgtgacaattaaaccgcgtaaatatctccgcttcaactgtacatcccgactaatttgatgaacgaccggagcaactgggacctcatcagacttgagtaacttatccaatgaaatctgtaaccgatcacttaattcaaccagtgtatccaaattcggatacgtacttccattttcccaacgtgaaaccgtctgccgagttacgtgcaactgatccgctaacacttgttgcgttaaaccaaacgcttcccgttgtagctttaaagcttgccctaattccaaatcatcagatcctttccgttatcaattcagcatattggcaagcacccgcaaaagtcgagcaactattgtgttacagcctgttacatccagcatgataatggctagctaattttttaaacccttctttcgacctgctaaactatagaatttatcaacgacctatctgcctaaatcattagtaaacaacacccgctactctacaccaactagagttagtcttatcataaaacaaatacacgtcgtcaactagatcagatcgatcttatcaacaacgtgcatgattcagttatttcaatcgtttcaacaaccatactggccggtgccgctcagacttgtgcacccgggtattaacgacttgtagcaattgtaaaatggtgaaaattagtgaattacgttttcggtacgcaatgtacttcggttcccactcggtcacatacttctctttgtacgaccgtaatccctgaaaaccatataactggtagccatattcgtaaattaaatgagcaattttttcttgaataaaactgtagcgtgaaacccctacaccggataatggtgccattcccatattgaaataagcatagccatcgtcacgcgcctgttcaaataggtgcacaaagaccgtgtccataatgccggatggcgccgatttgctcgaccgcattaagtcaattgaagtcgtctgatgatttccctgcggcataatattcgcaaacgcgacaattcggtggtcaggatcataaacgaccgctacgggtgcctgattgagatactgctcatcaaaaaatccgagcgagaatcctttttccgtctcacctgctaaccaactatccgaaacggctcgtaattcagccataacgtcggcactgaacggtggctgcaagatggcaaactcatagtgatcacgggtaaacttattcattagggcccgctcaccccgtagccgtttaccagccaaactaaagtctgccaatttaacgtgcccttcttcaccagttttgataaagtcaaagcccatttcgtgtaggcgcatcgtcagcatctcactaatttcgtaaaagactagcgagcaaccgtcactatctgcgtcatccaataactgttccaaggcagcttgtaataccgcttgattaccgaatggctctcccataataatcagtttatcagccttctgctggtataagaagatcagttgatcgaccccatcgacttgatagtaatatgctaacttatcattcaaataagccaagtgtgagatttcattgccgccataagtttcaatcacttgtttgacccgagccgcatccatcttttgacgcaatcgggcgttatagccactcgcaaagtagcggtacataataatcaaaatcattgccgctaagactaacccaatcaccccaaataaccagagcttttgtgatgggaagaacagagcttcaggaaccgcatgccgatgatgaatttggggcgcgttatagacccccacaatcgtatacaagataaaggtcaccacatacacgcagctaacccacaacgtttgcccccacgaaaaagccaaccgatcacgataataagcatgccgcgacaaagccactagcgctagaatcacaatcaagaaaatcacaaatttcatcgaaattgcatcataaacgacgagccagcgaatcgtattcaaaattgcaatcagcaggacaatcaccgttggccaaaaagcttttttgacccggccagcagttcccaacgccaccccaatcagtaagaaggccataataatactgctggcctgattaataaagaaaaaggtgtacggataaaactgtaagaagagtttattgttatatgcaaagttagggaccgttgacatcaacaacatcagaaaaccagaaaaatagagaaaaaccgtcagtaccatctgagcaacacgttgtaatgcctgcttaggaatacccgctaagcgcacgtttaagcgatggccggtgtcatggatgaataagaccaacccgatggcaaacgggataatatagtagaataaccggtaaaataagagccatgcgactgcgtctggtcgagaaactccgaccgcaccgaggccaaaaatcatgaaaacgtcgaatgacccaataccaccgggtaccattgacacttcaccgacaaccgaagcaatcacgaataacggcacgaccgctgcaaaatcaatgggtaatcccataaagtttccaattaataagaagaacagtacacagccagtccattcaccaaacgacccactcaataaccgaacgacgttgccgagcgtaaggccatcgaagaattccgaatcgttgactcgtgtaaaaataaagatggctggaaaatacagtgcaccaccgacgagccagatccagtaactgccatacatgttcccaatgccaaagccatagactagcacgagtgaaatcatacaatataatgacaatcccgaaactaaaaacaaagcgatcttggaaatggcaaacacgatttgtttcttagtggcttcgcgattataaaagttagcacgcagtgaggcgcccagcacgcccccaaaaccaccgatattcgtaaatgtattggtgatccatccagcttttaagatatagccaagtgaatagtggttgggtaaaaactttgtaatcatgacgtcatacgtcagcattggtgtcactgcgataataccaatcacgaccatgcttaacagatgccaccagctttgcgaagcaagcgcattcgccaactgcgcgccactgacttccttcgcaattttgccgacttccgtaatcacaaataacaggacagagaatacaaataatgctttgatgatccccatgcgtttattgagtgccgtcccgattttctgtaacgttgccttcaaaaaaattcccccattggtgtgtttgttctattatcgcaatcttagcctgtttatacaaccgttataggtcgttaataacccccacaggtctgatttgtcgccgtattaagctatgaacattttaaatatctactactaaattgttccgaatgggtgttagtagttagcactaattatgattaattatcgaaattaataccagcataaaccaatattaattgatttttagttaccaaactcgctttaccaacctttaccgtttatgtataattaaagtgatacataaacaaggaggaatttcttatgcaccatgcaaaaaaactcgtcgttgcactaacgagtctactcatcttaaccggctgtaccactggtaatcaacaagccgccaaccataccagtgtcaaaaccaagacggttcgggttgagaaacggactgctgctaataaagccgcctgggcaaaagcaagggccgctagtcgggctaacgcggcctcagccaaagctcttagttcaaacacgacccaactcgcaattgcaactagtcaggctaagcgtcaatccgaacaactaaaagcaaaacatgacgacgcaatggcatcatcaaaatcagcgtcacaggctgccgccaaatcagctgctagtgaagcggccgcacaatcacgctcccagtcagaagctcagtccgcttcggccgtcgcagccgctagccaatctaagcaagcggtcaaggccagcagtcaagcagctgctcaaagtcaacaaactcaaactagtaccgcaaccacgagtcggcagaataatttttctggcgataccgataccgcccaaactggacgcatcgtgggtaaccgtaattccaaaatttatcacgttgaaacgggtcaaaactaccggatggccggtaaaaatgccgtttactttagtacggaagacgcggcgcgggccgctggtttccgtaagtcatttcgataggaggatcacttcatggcattgatcggcaccatcttattatttgcaaccctgtactggttctggcgcttacatcggcgctaccgtgggcgtcaatggtggcggcatagttggccggccattatcgcattgctcgtcagctttagtattctcggcacatctgatgaatccactcagccaactgtgaagacaaagaccgttactaagacccacttagtaacggctaataatgacaagcaactgacggcacttcaagctgccaatcgtgcttctgctagcagcttaaagcaggctgcgaaaaaactttcgagtagtcaacaacatattgacaagctcaaggctacgaacaagcaagctggcgcaacttcgacaacagcaccaaccaaggtcaattctgaccataacccaagtaacaatgcgttggctagtaaaacttacaacggtcaacaaacgatcacgattaatcagaatcagcccgcatttaccgctaaggagctcagtacgagtcagggtgcctggcaacaatatggcaatttagactcacttaaccgggtgacggctgctaatgccctcttaaatcagtcactgatgcccaaagctgaacgtgaggccttgaatgttcgaccaactggttggcataacaaacgcatcagtagcggttggctttacaaccgcagtcatctgattggctatcaattaacggggcagaacaacaatatcaagaacctcatgaccggaacccgttctttgaatgaccctgaaatgacgacctatgaaaaccaagttgcggcctatttgaaagaaagtccgaaaaactacgtccgctaccaagtgacccccattttcaaaggtaacgaattgttagcccgcggtgttcaaatgcgtggtcagtcagttggtagcaatactgttagttttaatgtctatattttcaatatccagcccggtatgaccttgaactatactgatggcactagtcaggtcagtcactaacgatcattgatcatcgtattcagcctatcacgcagcagccacaaaagtgatagtgccctgtcgaccagaagttcaacccaagtgaaattttaaaacaagcccaacagacgtactatgcgacgttctgttgggcttgttttgacttgcttaatccaatacggttacgcctctaacgccaagtcaccgtaatcatacggtggttgatatcaaattgcactaacacttagcctaagtataaattctcagtaatcgttatatgcgtggtcatgcacgtgattcgcaccaacgccacatccagagataaaaaaaaaccacaccccatagtagggtgtggtctgatgacgttccgttaagtaaataattacttaagggtaacactccttcttgccttcgcatcagtggtttaacatagcctgtaccagaatcgtaccagaatgcagttaaaatcaatttctattatattgccggtgcttcatttttccagttttacatctttgtgtgtttttgtaaacctgtcaaaaaatccctacactggcaattgctggtgtagggacttcaatttattttacatacaaattcacttgatacttaacaatttatcttgtttttttgcttcttctattgaacgctcattatatgtaaatacattaataccttcaatagataaaaaatcgccatcatctgtaacaatatttttaataccattttgactgataaaattagccattaacacgtctgtcccatccaatgttgtatttttaagagtgttcacaaactcttctccactaatataattaagtacttccacaaacttttcatcacttgctgagattttatccatgaatactatagacgctctaacactattagaaacgtcctctcgttccccagatacttttcgaaattctttcaccttatgacaattactgtgagtttccttatactttttatatttatctatctctattatgtgagccagttctccatagctcaaatgggaatacaataattcgaaatttttgtgattataaattttattgataaattcagcatatttgggcttttgagattcaatatttgcaccttcatacgttaaccaataccaaatattagtatctaagtacaggcttactttttcatgcattatattagtattaaacaaatttaaatcataaataccatcacattttatttgcattgtagctcctattgtttattaattgcattatttttgcaacgttcataagtttcaagatcatcgctctcaagaccggtaactgttattcttttgtttaactcttctaaatcacctaactcttttaagtccgcaaacattgcattaaaaaataatgatgtaaatggtgaaatcccattaaaatcgagagaaacactatttccctctaactccctttttagagcattccctagtttatgaccaccgattggtgaaaacgaatcttcaatcacatttttgactattatcttttgcattacaaagtccaccctcatcagtccttaaattcattctgatacccatatcgaacattattttgctttgtcattcttatatttatcattgtacccgaaaaatcagttggtagagcattaactttcatctttccttgagtaatacgtaaaaatacgccattacaatatatatccatactaccactattaatttttaaaaaatcatatatcaaagataaacctaatccgccactattatcaagtcttgttgtatttcctgacttaagagcccatttaatggcattctcttccgtaatttcatcttcatttattaaaaaatagtcttgcacagattttacaattccaatgcctaaatcaactatagttagcacaatttccttatcttcattatagctttgaccacatgaaaaacatcctactggactttgagcatgttccaatgcattcgcaaaaagttcatacatttttgctgttaagtcactttttaattttggcctaatctctattaagctatcctttaaccactcttcctgaatatacttgactattttaacgcttaattcttcactctcttttatattacctctaaaactagtaaatcttattgcatctgctgaaatggtattatcttcactgaaacgtggtccaaaattgctactaagaaaaccatctttttttaacattccaagaacagaatccttcattgttgcaaatgaatatagcacatcataccccttatcttttaatagtgtgctaattgcacctaagtaggctattgcactttgtctcaagaaatgacactctttaaaggtaaaaagaaaatttgagtcattaggattattagtttttgtatcatcgattaatcgcttgtttaaatcaataagccataaaaaatcatcgtgtccgtcatttactgtacgaattgcatattctaatactttttttgtcatcaattctccatttttctactagttattgtatttcattatacctaaccaataagttgaacacaaacaccataagtagtttacagacacttcttaacaaaaatacgtaaattcaaaaaaatccccacgccagcaattgctagtgtagggatttcgtctattttataatcaattttgtgcctggataaatcgttgaatagatactcttgccattttgactagctaacgtagtcatgtttaggccgttccgttgagcaatcaaccaacatgaatcaccagacttgaccttataataagtgtgagaataaccagctttagaataccacctgccaattaccagtaatgtagtttcacagtagtgagtattaaagttgcacgatttctcatatatttctatgataataatggaacctactaatatctggtttcctctttcgctaagatactttctcttatgtattagccgtctgcctttacagcaagcggtttttttatgcaaaaaatcccccacgccgaaacgtaggggaaacgttgcagagtgatcaagctccacaacaaatgaaaatctctatcaagttatagccagtagttattatagcactattttgctgcttgtgaggcggattctgacgtcgtttcagcgtcagatgatgcagaactattcactacagtggctgtagacataggtgcttgtaattcgtcagcggtctgattagcagtcgcttcaatccggctttcttcatcgttatcagtcgttggtgccgtcactgtttgaacgtcagtaataacgcccagcatacctaaaatggtcagcaccgtgttaataacggccacaatgctggtccagtcaccggcaaacttgatgccaaacacagctagcacctgttgaatcaaaacgatcagcaacgaaataatcccagcaatcaacttaccatttaagcttccgtcggcattcttgaaactaatttttttcattttctttggcttccttttcatataggtgtttaaattcaatgtcatgaccatctaaccggccttctaccttaatgacccgattttcaatcgcgttcattgtgtcggcgttttgctgtcgtacttttaaactttcattggtaaaacggctaagccgcttgcctaaatcgttaagcggaatacggaccgtcttattgagaatccaattagctaatacacaaatactagtgacaatggcaacaatggatccccattcatcccaacctaatcctaatagtgtatgcaattaccgcaccaccaatcgctgaccaggatagatagtagtgtaaatcgtcttgccattctgattagctaatgcagtcatacttaggccgttgcgctgagcgattgaccaccagctgtcgccagacttgactgtgtaatacgtatgactaaccagctgaccagtaactcgcttcccgtagtcatgaccattagtgacgcctaacttgataaatccatacagaccatttgaacgggtataacgggcccatacataatcgtgttcaataataaccgcgttgtaaattacactctcacccttgtaataggtagccacttgacgtaccttgtctgaatccgtgtagcgaacagctagtgtccgattaggataaaacacccctcgctggctgtatttaacaaccttaaaagtgtccttcttagttgcctgagccttttgagcctgcttaacattggcctgtgctttagccttgctagcagttgtgtagcctgatttagtgatccctgttaaatcgacattgccatctaatccttgtggaacaccgttaacatagccagtaatccgatacatgcttgtaaactggaagatagccacgccatccatgctaggaaaccagttgtaatcagggctagttctcaccagatagtctggatattcagctagccatagacagctaccataggttttgacaatagcagccacattaacatgagcatttaggtaggccttgccggagtacagcataggtgtatagccgtacgacttaattaacttaaattgagctagaatgacattagtgttagctgtcacgctattagaagcaccgtcctcatagtctagtgcgacaatactccctttgggcgtcctaacacgtggcaagtaataggccatcatagccttagcattggtcatattgccaccgacaccgtcccataaataggtatgcactcgtttaccagcctgttgagccgatttaacttggctgttatacgtggtctggggaatattagttccaccatagaagccacccgcctgtgatagcacgaacttatcggtgctatagccgaatgtcccactattaccgttatacttggaccaatccggcccttgatcacgactagttgaagcctgactgtttaaattgaccattaaaaaggccataaaaatggcgcccaccattaagacgagtaccttaaacttgcgattattcaattgcctacctcctgaatgcaaggattgtttaaatagttaaaataaggccaatacgcaaaaacacgttgccccaatcgttttaatttattgaccacattccatcatctccataaaaaaagcgctgtccttagacatgcgctgcgtattatcaccgtcatcgatcatcatttaacgcttccggtcagttgatcatattgatctgcagtaatcatcgccaccgctttaaatgttcctaagtcgtccgttgtgtaaagcccaatagtataaaagtatttgatattctcaaaaaacattatttagcacctcccaactgttcaatttgtgatgcctgcgtagcctgtgtggccttaatagttgcaatttggaggaggattgaagccgtcatcttatcatcatctgatggggtgactggtactgccggattatctttgcgccaagcgtcctcgtcaatcccaacccaagcagatccattccatgacggggcatataggccatctgctggtgcaactgaagttgcatttgatggcatggggcttggcatatcttcctcgttttgataaaaaatactattgactaatttaaaattcgaatcccaaaagtataaaattttcattattactacccctttctaagctacccagatcagcaatccattcaagtaatcatctttggcgacagttgggtgtgtagccgagctttcaactaagattgaccgatctgtcccaattgtgatgccaaatgaattaccgccatttgttcgtactaagaattgtccgacagccccggctttaaaaggatcaggcaaggtggcacacactgtatttgccgtaatcccagtcattgcaattttaaggaacgtgatattacccaccttccggaccatcgttttattctgatcagtttggtttacaaagccgttaattagggtcaatggcacccatccagtatcagttgttgcagtatccagtttttcaagctcgttatttaacgctacgtcccagttagctgagccatgatcaatttgtgtcattttaaaaacccctttttatcttttattgtgcaaataccgtgttatcacaatgaattccgattgtggcgcgtccagaaatcaggtacatccatttaccatcaccggatctgttctgaacaaaattgtcaatcgcaaagtctggtaaaacagtattgatttgtttcaacaagaaatttggtaccagtgttgcactaccatcgcgaaggccataggccagatcaagcttggttacttccggattaccaaaataagccgtttcttggctaagccccgccccattgtagtaagcgtaggcctcaaacgaaggcaactggttgtatggaagcccactgatgtcaatcttaagagccaaatcatttaaagatgttcgtgacagatccgctttggtgattaatcctttggaatcaatttgagccgccaacgtttttagttgcgcatccagtacatctttagcggcaactaagttagcatagtccgtgtcccatttcgccacagcgtcgctaaacttaccgcgccactcggttagtaatgcctgactatcagtctggaactcggtcaaattgttagtaaccaacgtaaattcatcagtgaacttctgagtccattggttaagagcatctttaaagttggcaccagcggttccaatgattgtttctaattgcccataaagatcttcaaatggagtgatataatccgccgggaccagcccggtgataaccttgtccgctaggactgtcatgtcaaattcaagcgtagtgacactatccccattgcgcatgattctaaaaaacgcctgcacgtagcttccggctacggcaaacgcttgttttggcatatcaaaacggaattgtccattattcgggtcaagaatgatggcatcacgagcgtcataaattttgtgagttttatctggtagaaccccttcaaaaactacgttgcaccctgttagattaaatggtgttttgtcatcattcatcacatcgacaaaaacctgccgcattgaattttcgtactgccgcgcttgcagccaattaaaatttgaacttttgaaatcgatttgaaagttctgaatatccttgaccaggtcacgtttgtctgacccgattacataagttagcttcatctaatcacttccctttcatttaaaataatcctctggggccggaacgctatcatgctcgatgtctccagtttcaagcatgacgtttgcaacactgatcgttgcattcgtattctcagccgaaaaaatgagtttatcagccgacgttagttgccgtttaagttgcatcgagaatgaaatgtgcttggttccattgaccatcggaatgcccagctcccgatatatccatgaaccgccaccgttgaagccaacgaaaattgaaccattatcggattcattaaaagttatatcagcagaaattcgaatatgggtctgagcaactaaccgactgtcagcatgcttggacaactggtacgccgcaatggtttgaccggcgacgtttcccttgcctatcaagctagagggactttgtgttgccaacgcgtaattcctaccgcccactctgctaactgggttagattcaatccgataaggctccgaaaagttatttttccagtcgctggaccctttagctaccaaaacaagtggtgtatcagaaacgttggtctcgtaactatctaggccataaggtggaataaacgcagctgttttattgagttttaatctgatgtcggtggaattattttcaatcgcgaatctaatttttgagtaattccggtttctatccatgtgtaaattaacctctaccaaagagccatttggaacattcgatccaatgtggtagtacatttctattccgggttgtggataaagatcgttcacacctgcctgtaaaaattgttcgggcaaagttaatcgataattggagattccattacccatcgcttctggcaaataatacatagtcgcattttgaacaattcgttgttcttcggccgattgaagcgggtaaactgtaaagtgttgcattcgagaaccgtcgcttgctccgatgttgatcagattatcccagttcttcccatcagttgtttctaatcggtaagatgccgtgttcgtaaatccgtcggcaaaacaataaagtttatcgccgttgacgcaaagcgagggaccctcaactcttaaatcaagatgattattagccgtctggaatggtaaatccatgacataagtgtagtaaccggtcgccgaatcgctcttataaagttgaatccgtggaagatagttactagttcccagtccaaattccagtttcatggccatgtaccaatcgcccttataatttacaatggttggatcaatgttggcttttacattcgttggtaagtcatagcccaatgggttccaaggaccaaacgtcatttcatcggtatcaaaacgtgcgtaatagattctcatatcggaatttacgtcataggtgttgttattgcctccacaggcaaacagatacaaatcgtctccatcagccacccattcgggcgcccagttaatttttgcattaggaattttaggaatctcaatggaattaaactttgtcaaatcagttgagtagtaaactttccacgaagtatctgccacaaggtacttacctccggaataagtgatactgggatcacgaatttcttcaccctccaaccctttaataacagacttattaatcgggtaaaacttctcgtaatcgctagtccaatagaggtctagtgacgtgtagttttgtcctgagaacgaagatgcaatcgccttgaatggataggtgcggctagttaaagaagtaccagagttgttacaaacaccgatgttccgcagaacctcaatgattgcatcagtatctgtccccataataatgcggttaatgcgggcagtaagttcttgagcctgttgtttcaagcgattcacagttacttgatcttgtgctgacagcttcccatcgacgcttgtatttatatttgttgtcagcgtgctcagttgctggttaatgttgccctgatatgttagcagctcattcaaaacttcttgagtcgtggcgaaattcgaaatgagcagattacggaatggtgcgtcattaactgaagacagttcattcgttgccagttgtattgccatcttcttcctccttttttactttttgccagatgactttcccatcattatcaatgctaggtacccatgcagtaccatctggtgacgtcaactgcccaattaaacttagtcgttggtccaagtcatcactagttactaactctggtttattggcaatcttctcccagctaattggaaactgcattgaaagaatattaatagcctgttgcaccgtcattttatccattcacggcaccacccaacgtattaagtctgtcaagtgtgttcgcatcggtgatcaaatcattgccatctacagcatcgagccctacttttaattgttcaatctgtttaccagagtcattatgtgcagtctgtaaacctgcggtaatctgtgtaaagcttttggtcatattgccaaatgtcacgctagtcgtcgctggattaaccaaatcaatcacggtttcactgattcgagtttcaacatccacactattgcgatcacgaatatagccgtaatttccaacctcactattattaataattccaggtaccgagttagtcttgaactcattcaatgtcgcagttcgctgaatcaacggcacatcttgtaattttgatttcaaatatgccaatagggaatcactattcgtgaatcgctcatcagaaattggctctgcatcaattacaccccacgttgttgcgttaggactcgtgtactcagcagtagccaatggtttttccttgtcgtctaacttacctgtacctttaatatgcgtagcaatcgtcgtgtaatcactctcatctgtcaacgagctaagattcaatccatctaaccaaacgaaagcatcacgcttaccgacttgtttataaatatcaatgtgcttgcccgtactagtccattcgaaattgaagtccgacatcaaagtgtttaagaataaatcaaacgctaatccagtaccgaaatcttcagaaaaatcataatgattgaaatcatcatgaatcgtatacgtaaaaccagtgccttcagtaattagctgcatgcagctatcgagcgactgggatccctttatactcttctcaacgtaatggtcatttaaatcgtgcacagcgcctagaaacgttgctttaacattgcgactaccaccgatgttagatccattcatggtctgaatacgataagcttcaccactatcagaatctagcaaaagcgtgcgtggttgcaacatgcctacagcagacgcattcgtacccgtgttaatgaacgtcaattccaactgcgccacttgattcacggtttcagtcaattgtgctgaaattgggataactggtagttcgttacctgttacatcacgtaaataaaacactgtcacacctcctaaacgtaatagcgtgtatcaaactccaaatcataattcgttgcacccgccaccagtaattcattaatccctttgacgtaatctaaataggcatgattccccttgctgtagacattcacgccatccacaactggaaccatgccatataaaattagagtttgggatttattcaatgcttggtttaactgaaacacctgccccgtagttttgttagtaattgataactgactagccacatctccatggaaggttaatgtggccgtcttgccatcagccagcagcggaattgagccaccaacaaacaccttgacgtcgctttgattggtgaaatgatacggcggcaaacatgcaaacggaatatcaaatcctaatggaatgttattcttcatgttagcagtagtgttaatcgtctcaccaaatccaccggtaacaactaaattaactgtgatatcctccgtcataataggtgacgcttcataagggtctacattaaacccatcatccgcatggactggccagcgaatcgatggaatgacgctactaacaacatagaaatcttcgtaaccacgaaataaatcaaacagcttcaaccgcattagttcttggtcaactgagtcaattgttttgacatcaaacactagtggtatcttgcgttcactcgtgtgtgtttcagatgaagttacattgtacttaccaactggcgtatacgttcgagtgaacgtcggtgcaggtggtgaaaacttttctacttgaatacctaaatcagatagccagtaattactgccatcctgttgaatcacttgaatatctaactccatctatttgcctcctctcgctcgatcaatgacaacatcttggcctagagccagcttaattaacggatactgggcattaaaaaggacaccgttatctagtttggcagtgatgttaactgtcttgctagtaattgcgtccactaatgacttgaccatgcctaatacctcagcagttccgttcgccgttgcaccactgactgcgacgggcccaccgttcttaggaacgtccacgggaatggtactctttaacccagcggcttgttccgcacttgtagcaacaaaagcctgctggccaaatgacatcttgacagcttggtccgttaaatacttgctgtaattcgattgatcatccggaatgtgaatctcacgttggttatgctcggaaacccaagcaagttgtttttcgtaggactcaccgcccttgtcaaaacgacgatggccgcttggcgcccaaccgcgattccacatcaaatcgttgtaccagtttgaatcgttaaataacgccaataattggtcataaccattagcacggttttcatggcctttaaccgcgtaataccggaatgtttgtccgataaattgaagcaacccttgggcagggtcaacaccagtattgacatccacatagccatgttgaaatactgttggattaccgccggactcgtgattgatggtattaaggattttcttaacgccatcttcaggcatcgatacgtgcatagcagcggcggctcgtttgatgtacggaatccaccgtgttacaccagcgccacccggattaccagcaccctcaatggctagtttctttagccaattggtttgtttcttttcccagtccttagtatctgggccaaactggttctgtgagccacccggaaataggttcatatcaaaacttgaatctattaatttttcccagttcttaatcgggtgctccatgaacttcatagcatcaccaaataggttcttgatccaatcaacgatgttaccaccagaaccagtcgcaaacatcggtaatcccatcattttaaggaatggtgccgctttttcagtatcctcacctgaaaagacttgagcaccgacaggcaagtgggtcacagttggaacagccggtgacagtcctaatgatccattaccgtaatcaatcaattctggcttataaccatcaccgactattgcagtttcaggacttgtgattttaccattagtaccggttttatgtggtattcctgtcgttatacttaacttgttttcagttgctgtgtaagaactcttgccaccaacagctttagacaatgcattaacgctagctccaccttgatcgaggttatgagccacaccctttccaactccgccagcagacttcaaggggtcggcagctttctcaactaggccttgattgaatgattccattgtatcgttaccagcaccaacagctttttgccccaaagtcataacatctttgatggtttgagcagtccctgtaactgaattaataggcacctttttctcaccgttgataccatcgttataactatccatggtcttacggccgctttcaccaatatcaatattagtcttccccttaaccatcgctgctaatactttcaagtagttttcagttgaaatttttttatcagcataagccttgttaagggtatccatggtccataacccttcgccagtgatattgattttagctccactctttacagctgactttagcttattcaatgcagatttagcaccagggatacccaattcaataccagttgctaaggtatcaatatctttttgaccaatctttttcaagttatgatcaaaaatattagaaattgctttaccatagcgtgtctttaaatcactcttggtaataattccaagatccaagcctaatttgagtgattgaatatcgctcttgcccagcttagataaatcttgcttaaaaatagcagcatattgtttgccataccggcttttcaactgagaatcagtaatatcaccactcttgagcccttcttttaaggttgctatatcagtttttccaagttttgataggtctttaggaaatagaccggtaatattgtctccgaactgctgttttaaatcagaaatagttacgactccatcggctaacccttgtttaagggtatcaatttcttttccgctcagcttggacaagtctttcgggaaaaggccaataattgtatttccaaaaacgggagctaaatctttcaaagataagattcccgttgaaagacctgatcgaagttcttcttgttcagaatcggttaaatcactgatattctttttgccgtcatccttgaagccagttagaattgaattgaaatatacttgtgcttcttcataaccctgtttgctaccagatttgacatcagtccagaactgttgtgcagttttatatccgtatttaccaagagaaatgtttgcagcgctatcagaaagatcaagtccccattgcttagcaacattggctgggcttcccaaagtgcctttattcaaagacttaacataattatcatgcgtcttttcagcacttgcggccaatttagcacctgcttttgttgtttctgccagcatattatcggcatctacctttgcttgtgcagcagcagtagagtcagacatccccattgcctcataggctttttcctgagacttctggaacttagctatattcttttcaatggtcccatgtgcgttgacttgatcatcaatgtacttctgattgtctttcttatgatcagcaatccacttagctgccgattcttcactgttactgacatcgtcccaataaagcttttcctttttaccattctcatcggtaatcgttttcgtgtatgcatcatcaagcgtttgcttagtacgcaagctttcgcgaccgttattgttatacgcatcgccagctgctttttcagttttgatgtattccagtgaggcctgagtttgctgcttgttacgtttagcatccagcatggcaagtgcttggtcgtattgacccttgctaatttggtcattttttcttaacgatttcagctcagacagactcttcttataactatcacttgccttgccataagtcttggaatatgccgaatctgctgacttgacgtccgccttatacatgccatctgtaatagttccatgctgttgcgcataagctttatacaaggcttgttggtccttgtaagccataccaaacgcggagacttgcgaatcaatgtaagcctcagcctcatttagcttagccttttgagtagtagatagcttcgagaagtcaccgtcaactgactttagaatgctctccatcgtttttttagctttttcgagcttactagtttgcccatcagcccgcttatcaacgcccttttcaacttgcgttacccagctattgccagcacttccaaagcttccggataagtcggatagtgcatccatcccggcctttttagtcttggaaaactgttgttcaaccaaatcagccatcttactgtatttagtaaccacatcgctagataattgtttggactgcttacctaccgcggtgtccaatagtgccatatcattcttggctttttgatgtagttcgttgaatgagccaattgctttttgcgagttttgactaatattggcaccatattcgtccatcgaagcacgttggcgcttcaactggtcactatgctccttgccggctttaatcgcaaagtaagttgctgttcccacagccgctacacctaacacgaccggggcggcagctgcagccaatgcacctaatccggatactgtacctagtgctgaaccacctaatcctagcaaagaagctgaacctgcttcagcaccaccactaagaccagcaatgacagtactggccgcaccgccatctttaactaaagtgccaaataacggtgatagtttagcagcaccaaccaatagtttcatagatccactagttagtagccctacaccagaggtcaatttcccaaacatgctaatcaatggaccaccagctgcaacagctaagcctgtattaagaattagcttctgcgttgccggatctaagtcgctaaaacggtctagcatattctttaactcacgaataatgggcgtgagggttggtaggaatttctgcccaaattcaatctctaaagcgtttaaactagatttaaattgggccatggtgaactgactcgtgttacgcatggttttgttgtatttatcaacggttccattgctgtgttcgatctcattagataacgatttgtaccgatcaagattagcgtccatcaaggtcataccgaccttcatgttttcctgaccaacaacgttgtacataaatgactggcgctgcttatcattcattttctggtaagcaccctgcatttgtccaagaatatcaaagacgtctttcattttgcctttgctatcgaatacttgaatattgtatttctttaaatccttagctgcttgacctgtccctgttccaactcgtgtcatcaatgatgacagccccgtaccaacagagctagcgtcaataccagcagactttaagcgccctgcaattgccataaattcatatgttttaacgcccatggcgtgcattgcagcaccagcattaccactaatttctttcaaatcgtctaatgacatggctgacttatgggtggcttcagtcatctgattcatcaagctattaccattcttgattacagtactgtttgaacccaagttctggccaaattgttcaagcatagaagcggtcagtttaatagactccccagactgatcggaattagcggtcatagtctttaacaactctggcatcattcccatggcttgtttgacattgtaaccattagaaaccaattcaaacataccatcattgatttctttggtaccaacaccaaactctttggaccattttaatgtatctgaagatagattcttcataattgagcttgtttggctagcagagtatccttgtgcaacaacttccttacggatatcagctaattgatattgataatcggaagcggctttagttgctacacccagtgctgtgacaataggcaccgtaaaaccaatagtggccttacttccaagagagctaatcttttcaccagcattttgtatcttagtccccattatcatggctttgtcagctgcggcagccatttcaggtgttaatgcaccaacactcttttgcagcttgcctgctgacaaaaccagagcttgctgttcacgttcaagggcagcatatttacttttagctgctactacttgagcagaattatcaccttctgctcgtgacagacgaccaatttcaccagctgttgctgtcatcgcttgtcggttagcttgcaactgtgctttataagagttcaacttagaaacttgagaagatatgtgcatccctgcttgttcttgagcggctgatagcttactatagctggctgcagttgtctctaacccttgattcaacacttttaagttggcggctgctttcgggctaacatccacgtctttaaatgttcgcttaagaacttcggcttgtgcaagcgcctctttagcgattaagtccacgttaatcttgacactaccagcaatatcagccatctacacacatcctttctatattttcccttgctcccgtagctctttcatacgtaacgccttatgtggcatatctaaattagccagctcgatagatagttcatctggtgtcagcttgccatcaccattggtgtgagcttgctttaatccataaatcagcttcatttgctttaaataagtttgcgtatcagcatccatatcatcactaactttggtcagtcgaaacctgacaacttttttaaattgcgtatcttcattaagaccatccaacatagtggtaaaccgttcccaactgaggctatctcggtctaaatcgataccgtattgttgttggaacccagccttgattaacgattcgtcttcatcaaaatcaaaagaccgcttaccagacttgagcaccttagctcgaacccgatcgcggtcattattgatttttgtattaaatatttcagacagcaactgacccttgtcctcaaaacgtagcttgctcgtatcgtccaataccagcgcttttaagccgacttctacacgctctggtatagtgaggccttcatcccggattgctttaaaatagagcaacaccatgcgaaatgaaaggtctaaacgataccgatgtttctgaaatacgatgctgttagtgtttatctcggtaaaactcattgttcattcttccgcaattctgtaatggactgtaagtacttgtcgcgataatcagaaatatccgtatgttgttctacgttaatcatgatttgagcgacaaccttagcaaataccaccatggaatcattgcaagtatggtatagttccttgccagcgtttttgccaaacatgccatcaagtaattgataaaagcgttccttagcttcaatcttatatttgttctgaatatcatcgtacattcgtaaatagcgtcgttgtaggacttgtttcttatgatctaacgccgtcattggctcgttaatcatatctttttccaattgagcttctttatcagttaattcaactgatcgatgatgtaactcctgctgtaatttcacctcagccattttaatgtcattatattgatctgtaaaaatagcaaatgatttatcagcaaaacttgccgtgtaattcttatcaccaatttcaaacgtcatactgtcactaggaacctctaatttaattacatcactcatgctagtacctcctaatatttttaatgctatgtatgacggattgctccgtcacttgcctacatactctttacaatagcgccatcgctagtaggcaatgattgaacatttgatggcgctgttattttgacggattaccgttgtcagttggcatattagccttaacacccaaaataatcgcattttgacaaggtgtatccttcaatgcagtttgcatatcagtaggattgcttgccttgattactgtgggagtagcattgtacgtcatcgttaccttgaagctaccgttatcgtccgcagcgccaccaccatcatcaatgtcagagaatgttcccatacctgattcaatcgcattaggtgttaatgaaccatcttcttcttgtacccattggactttacggaacatccgttcacgtaagccaccagtcttttgcttcatgtcggcaatatcatcttgggccgggttcccaattgaacgatcaccagaaatatcatacgatgacgttacaccagtaactgtctgtcgttcttggccaccaccattgtagtaggcagcagacttcttcttatcagtatatttaggcgttacagtcgtaatcccatcacctaaatataaccagttgatcgtcttatctgccgcagtttttcctacccaatattcatctaaatagttttcttgaattgacccctggacgtttctgtcgttcgggtcagctgttggtgttgttgcatcagccattttgcattcctcctaaattaaataattacttgtacactaaaagcgccttgatagacaccatacttttgagcatcttgaccatcgtcatcctgaacagtggctagaaactccggtgaggttgtcatcttagcgcttatgaatttgaaacttccattctcacttttgattgatatcggcgttgcattctccatgatgtccataatggcactgagagtgttaatacaaacaattccgtgtggatgtttagcagtgattgcaaatgcaaaactacggcggcggcgaccgtcataatatcgcgttgccggtccagcgggttgcaatgtataactcagtgacattccaggagcatagtcattgccaagtgttaacgtatcaaacagcttaacgttagcactaatataattagcaacccgaacatccagatcaaggtcaacttgactcactacgtcgcccccaatccgtgtgccacgagcgctgcccaattgtgaccattaaccaaataggctttatcaacccaacccttttgcgctaacgcatgcttagtgtggttataattcaaaggccgattcgtcactactttgtgatagcctctccgctgacccattgtatccggtgccttcaccattactttaccaccgtacatataggctgcatacggctctgtccaaacaatagtaacgccggtgcctgtttgaattctcgatacatggccggctaaataaccatttagaaatggcacatattggtcagaatcacgcacaatcacatctgctagtcggtttgtcagcacattaagattgttcaaacgtgtaactaatggtgacaagtctactttgttagtcattgcagcaccccttcccaatgatgaacatgcgtaccgaaatcataaataggatcaagactcttcacgattagcgattggtgagtactttgtacttcaactttatcgttaagcttgggcaacctatctagtggcgctgaattagctgaatcaataattaatgtgtaagccccagtgataacctgtgtactaacattgtcaccaacagattgcactgacaccgaagttgcaggttcaactcgtacatgtgaaatcatgtagtcatcagctccgttgctatctgagctggtagtccatgaatcttgtttggctttattagcgtcgtagggtgtcactttgatggcatcatctaacaactcaatgggaattggatcaataatatcatccatttagtgcaccccacgatacaatagaccagttggtcgtaagtagttgattgccgcatttgagcgctgtgccgtaccacgtggcagcgttgctggcgctgacttctcataactaaatttgcctatcgttacatgactaatccctttagccgattgtttagcgttagccagttcttcaaccccaccagaatcaataaaccattcaatctgagcgcagacagccttcttcacgttaatttggtcagcatcaagtggcaaatcatcaagactatgcgaatcgaaataataatttgcgtattgattgaccatctcttccgcccgaatttccaaacgttcaaacttaatatttgctggtaccgtctcgccaaaataaacattattgtaaaaatcttgatctactatcggcatctaatcacctctaactagcagttacactggcaccatcagtggttgctgtagctttaacatcttgtggatcagcgggcttggcggcaagaaccgtaaatccgggaacatctaccttgtcactcgcttggctaccgtccacataggcaacctgatagtcaccagtagcgacaactgtgccagctgctaagccagtaattgcaacactggttgcatcaccagttgcaattgccgtttcgttgcccttttgataagcattcaacactttagccattctacattcctcctaattttaattgcctactttgctgtgatcttcgcaccgtcattcgtaggcattgctttaacattagacggtggcattattttgacggcgtatcagatgccacagctttacccttattggattttttaaccgtagcatccttagtgctggttacgttttggttaataacagtaccgccttcgacatcaaatggattaatgactaacaacttagtgtcatcatagattgcaaccccataatgttcatcggcattaaacttagtgatcttatgatccatatcgcgacccttttcagagagaacattccgtttcatgtaggtacgcattgcacccggcttaactgccaaggcggagccttctttgattttacgtgaccgcacaatttgccatccgagtaactcaccaaatgtgccattaatcaagatgttgtcacctaaatcagttgctcgcgtccagttctcagcagcggccttacgtagtttattgacatctttagggttcataaacaatacgcccgtggtcggtgaatcatcttctaccgcatattcactcgtatcatcattaaatgcagcttcaattgcatcgaccatatccaatgacgtaacatcaacgccagtacttagcgtaagtcgtgctttcattgcagtagccaagatatcattgtcaatcttagatgcaattgccatcgtaatttgtcgctgaccttcgcctactggatctccgtatccggatagagcggcttcgtcagtaatcttgacacctttacctgctttcttaatcgtgaacatgtcggtatctgttgaaagactggcataatcaatagcaccaccttcatcgacatccgtcgcatctccgatatacttgtatcgaggtacagttacatcagtacctggtcgaccttcaagtgtggtgtcaacaggtgcaatagcactaaaccgaattgccttaggtaatttagcactaatcatcgcagtcataacttgtggatcaatcaggttatctaatacagttgtttcatctgccatgtgttatttcctcctaattatttgttagttttgtaacagcttgcttgtatacatccgggtgctcaagtttcagtttggcagcttcaccgtagctaatctttgataaatctggcactgtaacgttaccttgaccaccactaaggttctgaccggcaatggctgttccttgtgcggcttctgcacccttaaatgctgggttacgctctaaaaccccagttaacgcttcatcgattgttttcacaccattagctttacttgctaagtcagccttagcgagcgccagcgcatcactcaaatgatcagcatcaactccctgtttaagagcagctacttgagcttccgcattgtcagcgcgactagtttcttttgcaagtttactggtagccttgtctaactcaccggatttagcctccaatgcactctgattagccgctacatctttattatgttgttcaacgacacctttcaagtcatcctcgttatcgaacccaagtgactttaataattcggcacgcgcttctgtggctacctgtttagtatcaattggcgtaggagtcggtactggatcagcaaccggcactggttcaggtgttggaactggattaccttctgccatatttattactcctctctaaattaaggtataaaaaataagccttttaacgccatgctaagggcactactgtttttctcgattgtattgacgtactagcccatgcttgttaacaaactgacgagtaactgactgacgacggctcactaattcttgtgcagccgtaatatcactttgattgccaaactttttagctgctatcaatttacgcttagcttttcgtacctcacgttcaaggcgacgctgagtttgttctaattgatacctagcagcattctcatcatccgactgttgtggcactgacatagcaccatagccatcaacatagggaattgtataatgtcggcaattaatgcccccaataccagtaatcgtaccgtatcccgttgttgattcaaaatctggatacttgtctgtattaccgtccaaagaataaatatggtcttgatactgtatgtgacttggacggcatccaatatgtgaactaactttaactaacgagccatactggcgatacctaagtaactctgtatcattcgtagcactattaatacttgagttaaccactgtccgcacatagacatctggtgaccattttcgaccagccttatcaacgagtgcgggtacaccttgttctgcccattgctcactagctttagctattgctttgatagcagttgtaccactatcaattgaccgctttgcatcaccaacaattcccctaaacatctgatacgcattagcgctcatattacgtctagcaaggttcagataattatccgtctctgttaactggtcatcaacaacttgcttaaactgttgcgaatccttaatcgaatccacttgctttccagtaacctttttaagccacttttcagcttgtttgacattatcttgactaattgtactaagtcttgtgtgcaattgcttagacgcatgctgtgtaggcgagacagttattttagcagcatattgcctaacatcatctgcatgattaagtaattcgtttatccattcattatcagtatcatcatgtttagatgcttcatttcctatcaggttgataatgaaagaccaaatcaaatcttcaacattagcatagttgttagcatcttcatccgaatatcccgataaatcccatggtttaagcattatcctcaccatctttaccgttaccaccgacaacatcttcaattgaaccttcagcgtttgctgtttctacattgatttggtcaagaacctgttgagcctcaacatcagtaattccattggcacgtttaattgcttccagctgtgtcataacgggatgattaccattcgccttcatgtaataatccaaattgtcattccggtctttagcaatcgaatcatcaaagttaacagaaatatcaatatctgtttgacctgaatattgaacattggaatcatttttagccagctccacaataatctggcaaatatgttcaattgcttctccaatcaacgtttcatgactgtttttggattgatacgtatcactattctcactaattaccgctgtcgctgtgataacaccctgtttgctgtcaaacgtaaacatatctgcgctgaaaccaatttgtgaagagtagaaatgcaacaaatcattgatgccagccacaattgcttcatttcgcagtcctaatgtaatatcagtcggtttcgctgactcaccatcaccgccactcattgtcgtgttgtatgccatgtagacatcttcactccaatcaacataataccgtgttttaccggtttgtgggtcaacttcacgtttcaattgatttgctggtgcggcaatacgccgttttcctttgacaaattcttggaataacaagtcataggcttcatctaactggcgcaatgtgtctatggcgttagcgtagataggaatacccaatggactgtcaatgtgcaagttattagctaaattaggctttaaatagataaacgtcggccgtgaataaagctttttggaatacctagttggctgcggtgacatgtttttaaatgcatccggcaagttactccaatcatcaattttcacacccaagtcatcattgctattggtcgtgctcttgtagacttcattagtcacgacatagtccgtatctgtttcttcatgccattccaataacgtatagtaatgactgtcactcatgaatttggaggcaatgacagcttcactgacaccattagcatctgacgtgattggatagaatgcatcagcggtagcaaatcgaatcttaactttaccacgatcggtatatagacgaatcacaatgccaccagttgcgaacatatattctaagtaacgttcaaaattgttataaaaatgattgtccttcaaggtttgctgtacgaactgattctcaaccgtttgataatcatctggcgatgagggatcatcaggattcttcgcgttctttgggctaacagtaatgacagccttttgattgaatactaaacttgccatcttcttggcggcaacttgtcccatgtttaatgacatcttttggcgatccaagtcagaatcatcgggtagctttttatgaattttcaaccattctggagctgattgataaatactaaaccacttagcaatcaatccgtactggtcatcatccgccattatttttttatgatcaggcacactttgcaactcagcagctaatcccattttaactaacaccccctttatccaatcatgtattctgttaaacaaggctagtaacctcccttgtatttcttcgtaaagtaattagcagcgtaccggcactcgtccattgcatggttattagcatcgaccggcttaccggttgtttcgtcacgtacatacataccaagttctttaacaaagtgataattatcatagctctgatttgctagtccactatcaggcgtatcaactaagacaaactgaccatctgcaatcaatgattgttgccgctgaatgccgacttcaattcctttagagttaccaacgtgatcatgcccgttgttatccgccttaccagcttcaacgccaaccttaattagctcttgtcgtaatgccaatgaagcggggtccactaacaccatcgagtagtgcagttggtatgtgttaacacaccacaaaataaatcttctcaattctgtggcatacgtactcatcgcctttgtttgtcccgtctccgtgccactgtgataataattagcaacgcgatttagaacaaacttaaaccgcccatcaggttgacggacgcgggtaacaatattgcaactcattgttgtggcatcatcttgaccagcatcaccagtaaagtacatttctactggctgtccaattaaggcatggttagtcatactgtcttggtcaaactggtcatagataatcccctgtggcatgactcttaatcctaaccaatcacgcttgtacagatatggatttttctttagctgcgtctccatctcagccagacgtttggttgtcatcactgggttatcagacatacgccaatgtaaccagtgcgcatcgcgctcatcaaaaaacttgataattgggtcttgtggagccggtgggttaaggtcagcaagatgatagcgatacttagctgcggccgtccgccgaaaggtttcgtcaaggaactcacggtttaacaagttgatttcagagtacgcgactgagcctaatgacataccacggatagcattggcactgtttgacttggccccacctttgaaataaatcttcttttttccactaggcaggtctaaagctaaatggtcgccaccgcgatcacgtctcaaatgactagcaccatcaaatatataggctagtcccatgccatcaccttcgataaacaggttataagcaagttcctggttataggcgctgactaagtggttttcatcagttgttgccaaataaaacatagctagtcgtgcatcatcagcagcggtcttacctgcacgaattgaaccttcattaacatcgaacaagtgatcaaacggtgaaaagatgaactctgcttgcttcttaccgtagctaatcttctctatcggtgtttgcatcgtcttctgcctcctttggtactaactgttgtgctcctttagctaaagctttaagcaatggatttacatgaccaacgccttcaagttcattagccttatgactactaatacgtgcctcagctttcgctttatcagtttgtgcttcattaagctgttggaaactttgatcacggtatgcttttggtttacgattacgtaaccaaaatatagctgcattaacatcaggtggaaattcatgaacattttcagtctgctgaatgcgcttatattcctttactcccgcaatagcagcgtcatcaatttctttcttagaggcctctgggtgctttaatttccaagcattgctaaaacgtcgcctttccatatcaagtacgtcatcgtctttatgaaccatgcgatacatcttgtcggttgtcgtggtccccatagcacgctttaatagtgcattctcaacttgccggtctacaacatccttgccttttcctatggtgtccgaaatgtccgaaaacctttttttccatgcgttcagcgtcgaacggctaatccccatgttatgcgctatctgctcatcagtgagaccgtcacgagcccagccaccaattcggacaagtccatcaggagttaaccatttttcatacttagccattacataccaccacacctccgtttttaaaccagtcgaaatcgacgggtttagaattaatctagtaagtcataagtctgtttgaaaatatcaggcttacatggataaagctcaccatgaactcctttaatgatgtaatcacccacattggcatgcattttgccttccaaggtgttgatgttccatccatttctagcctcattcattacacgatcagccattgcattaaaaatccaagctggaactttatcatctatacctaggtcagttacttgccaatactcaataactactggtttcttttgtgctttcatgttgcacctccttatttttgaccaaactaaaagcgccatgctgtttagcacgacgcttatccttgtaccacttatctagccgggcatcagcctgcacccattcaggcggctcgtacccgtatttacttcttatcattttcgccatgaggcacctcgtcatcgatcagcttagctagccgtctcaactcatcaaagctaattgacattgctacactgtctccaccaacatcatcggtagccaataagaaaccacttgatggattaattgccaggcttagttcctcaccaaaaccatcttgataattaaagcttttttgcattgcgctacctcctaatcgtatgtactaaaaaagcctgacgccagccaggcctatgtattgttgtctcataagatggcgatcccgttattcaacaatacaatttaatatcatactatattcaacattatttgagttgcaatacacactatttactttactaaaaagagcccaactaaatgtcagactcctacacacagctgttatcagaaaaacgattatagtttttgtaaccatgtttgattatgttaccacagcgcacatgtttccgcatgtaatctggtggccgtttgattgcgcgtcttatgtaagtgccgtccagttttccacgctgaatggcaagcgagtaagcagttattgttgattcaaatgatttcacgcactatcgcttgcatacttgcttgcttaatgtgcttggtagggatttgcaccctacatggagccacccaatatacgctgctaatggtcttaagcattccacatacatatactctctcacatggatgaattgtgcgcgtctacctattccgccacaagcacgcgttatgcggtcaactcccattgggtgctgtatcacataactatatcgctggtaggagtcgaacctacatcccattgtggcttgccaattagcccacggcgatactcgcattcaacggccgacgttaaacacgaagactaatgccggcggcagagaggagcgcatcaccccttataaatccgccggctacacagatagctggatttgaaccaacatagacgttttggagaccgccatcttgccaattagatcatatctgcttaataatggcacttaattcagttatgcttatacttaatttatagaaaggaggtcatattatgaatttaattcctgttatttctagagacctatcagaagttgggtataactcaaacactcaacagctagaaattgtatttaatagtggtggagtctatctgtacagcggcgtcacatctgacgagtatcaaggcttaatgaatgccagttctaaaggccgatactttcacgctttcatcaaacatcatccatatgtgcgcataaactaatccatattgacaatgatcactgctggaccatcaaagctaaagactttctgatctccaacagtgatttttgcttgctcctctaactgtaagctaatggtctgaatgcctaagcgagattctaattccttcgaaagctctctagttgttacatgctttaaatccattatttcatcttcctttccttgaaattgacgtagcctgctggactcgaaccagcgacaacctgattaacagtcaggcgctctaccaactgagctaaggccacaataataatcaattagagctatcagaaaaacgtttatttgtcgccctaaccaattatcgataatactaatttaccaccaatttattgctatgaagtccggcttgagttcggaaaaagttcggttaaagtccggtttgagttcggttttggtaaatattcaggtcttctaggtaatagctctgtgcaaactgcagcattgccaatggcttccagcggtcaaaatactgcgtcttgctgtagccaatatccatgtagcacatcgtgtcgctgtaaccttgcaaatatagccgatccaatatctcctggcactcatgatcacagcgagccattgcctgaatagtctgtcggacaatctgttcggcatataggcggcgtgtaatccgatcctcggccgaattaccagctggggccgacttaggcatgccatccatgctaggcgattttaaatcagcgaccgaatggccggacgcccgaactgcttgcggtaacttcttatccaagaaccgccgcacctgtttaattgttttctcttggtcaattggtggaaaaatttcatctgaaataacttgctgttcgcccatcatgcgcccctccgctttcgtatgctataattaacttattcggaattagttgtagcgcggtcagcgatggcagcgcttttttatgttatacttacaacggtcattcgagtggtcccgtgactggtcgccttaacgggcggctttttgtttgcttcggcgtgttgcttcatgcgccggtgcttccgtttaatcgttgaacgtttcttagtgtgtttaggcatcttcgtccctcccaaaggtatcatcaaatattgctggtaaaattgaataagcttttaaagcttattgatatttctcttcacttatctgtttatctggattgatgtgaaattgtgttgtagtttgaataccatatttttcatatatttcttgaaataaatcccgatacgttttagcatttccggacatagctcataatccttccggtacacactctttaatgtacgtgtcaaactgccgttcaatttcatgactctttatggctaactgatccactgtttttatgtgctcactaccagtccggattaaatacccacgaagccagcgcaatgcgtcctcgacgtttttacagtgtgctaggggtacttctaccagccgattaataccagacttttcatcgtagctagttaccggatgcccatggctgtctaatgacatcctgttaaccttaacttcgtatttgtcactagtcagatgatactgtccaattttcatatcaatcatgattattcgtcctccgtgatttcatctatttctactctaggatttcgtttatcaacggcaaattcgtcctggaatcctgtgatgtgctttcgattatcgttgcctaaaagcccagccttcataaagccgtccagcacaaactttttagcaaacgcgatattatccgcatctttccggttgttcttcgtgtaccacgtaaatttaagcttgcaaggccaactgaattcaactccggaattccgacttgcccgcgcatatacgctgcacagggctgtatatcgcttcttgagactagctgcggcgtatctgttggcccgttcagccttgatgtactcatttaagctaggtagttcgcccttaatcacgactttgctcatactttcggcacccggctgatgtaatagccgcaaacaatgccatttgaataacttgcttgtctaatcgattgggatggcgcaccgagcttgtcacccaacaactcgactgtttgtccagtaataatctcgttgggattgtcgtacttctcggcccgccagtactcgttgcgtagcggcaagctatacttgtgtacgagatagctcacttgcttggtaatatagccagtttcgtctgtcaacgctctaatcgtgtgttttccggcgcgatgagcatggcaaatctctttaatttgctcacgttcctcggtctcggggtccggccgcatgcttgccaagtatgccttatcatcccacgactgagcctgctcgggctcaatgaccactggaaactgccactcgccatgttggtactttgccagtaccaaacgatgtagctctggttcattgccagtagctagcactttatgtcgctgatcaatcgtttttactgcatacattagacagcacccccgctaattccttttcatagtgctggtgtacagcttgcgtgcagttagggcacggctgtactacccagacacctttcataatctcaacatgtacaatttttgtgccattacattcacacattagaacgatacctcccgtttgtctggggtcgcagccgtaaagctgatgacgtgcccattgatgccacgatatagacgcgaaatgatttttggattataaacgctagccaagtcggcactacctaagttggtcgtgataatggttcgctggcgattattcacgatgccaaacaacacatattgcacgtaatcgctagcttcctttcggttcttgctttgatggctttgaaatgttgcctctgagcctaggtcgtcaagtacaagcaagtctgcatcacttagtagctgaaccatgttatgctcgttatatcggctgtcaggatggccgaagctgcttttaatcagccggaacaattcatttacgctaacgaatagacaggccataggtttgtctgcgtgatcatttaccgctttagcaatggataaggccaaatgtgacttaccacgccccggcagtcccgtcagtatcgtgttgtacgtggttgccggattcaaatactcgctagcaatcttccgtgccaacttcaagttcttagctgactccgggctgtttggacggaaattatcaaagttggcatccatcaaggttggatcatcgaaaattgagtccatagctagcacatccgaagtccggcgcttatgccagtagtcatttgcgttgtcaataatcttgtggttttgctgttcaattttttcttttgtgcaaaccatgcagaatggctggtgtccctgcatgtaaaccatattcacaccatgccgtgggcaaacttggtcactggtctttaaccgttgtagctcaggaaagctaatccctcgcgcactcttagaagtcgtttctgacataggtttgcgcctccttcgatgtctggttgctaccatccactgctggttgtgtaggcatcgtcatatcgtactcatccatccagccacggccaccgagccaattatctaaacttttggtatagtactcacccgtgccatgtagctttaagtaagccttatactcgttaatcttggcaacaatggtctctaagctaactccctcaaccttggctgcataatacgcgttataagccttttgaaagtcacgcttttttggatagattgaccaaacctgttcggtaaattcttgctggatgcggtcacgaggatcacgcggtttggttttattttttttgttattatttgatttactttgttctgatatactatgtggattgtcagcgctgtttactctgtttccagcgttggaaaccctattatcagcattgtaaacccgtggcaaacgatactgattaagaatcgagctatctttcttctgtcgagaagccaatttatagttctcttgaattcgcttagacgttaagattttttcttgcttgaacatctcagcgtcgaaaaaccctacctcacttgcttttaaaaccacgtcctgtactgcgctttccttggcaccaatatcatcagccaccaagaaccgcatatcagcatcccacgtcatgtaatacccttcatcttgataaatattacagagcaggcagattagtacagcgatcgattgatttccacaagcacgcatgattttacggaccttaatgtcacgcagaaaatctacatctaagttgaagtagtcaattcccttcttaattggacgggccatctcgcacctcctgtccttattaatgggcctttcacccattcggtggattcagtcactgctgcattcaagccaattctgtttagttaatctatgagtaagtcgtctgcactaacgacactctctaacttcttagtactacgacaataagcacaatgcccgcattggatagggtccgcttcacctttaatgacatcttgaatatgctgttgagattccaatacctgtttcatagcgttagtaagtcggtactccggtaaatcaatagcctgcttgtctggtggatcctgtttgcttactgccacgatgtacggtttacacgtcacaccaaactgctgcttaatcagttcctgatacacggccatttgaagctgatagttatacgcataaacaaatggttctcgttcacggctttcttcattccaataacctttataaatatcagcggtcgtctttagatccacgaagtaaccttgtttcaaattgaggcaatcaacctttcccttccagggataaccatcgattttaccagttacaatcacttccttatcgccttgataaagaagattaaaatcatggtcgtcagataaggcttcaatcatggattcagcaattttgaagtcctttttgagctggcctttgctgggaccccgacttgaaattgcctctggatgttcatcaacaaacttggcatgagctttctcactttcgaaatagctgtgaagccaattcccaacgactagcgccgttgagttcataactggctcccatttaccctgcaactcggcgagtgcttcagcctcacaggctaaaaacttcttgaaccatgttgctgacataaatgattgatctgtccagcgatcgtaatagttagccggcgtcaaggtctccgaggttgtcgaagaggttttgctagtcgacttcgcctttgacaggttcttgatcattgcttgatgcctcctttacagccgttctaatgggttctttagctggttcggcagattctaccttctcggctttattctctgctacatcagcttccaatgaccttttagtcggtgttacgtcttttctatcgtcattcttatattcgttgctagtggtttcgttaactgcttgcacgaacaaatcgttatcacttgagctgttaatgtagaacttagcagctcgattaattacagtccttttagccatctcttctgggaactcgttttgaaccttcttcgtcttagcgtggctccaactggtgtcgatgtccttttttgtcataaccgtgtatgtccggttcccattgatgtcttcgatccatgcaaaggcccctataattggcttatctaggttctcaaagcttggctcgaactctttaaccaccaacactccattttcaccaccaatcttgaacgtgtcgtctttgtggacaacctgtgcctgaatatctttcacatttgaaagacgctttacaacgctaattgagccgaaataggagcgttgcatgactaactggttgccataaggaatgaaatagcactgattcttagcagggcttagtccctggattgccatattcatcaaagctttgataacagatccttgatcacatttatctagtagtggttggcccttagacgtatcactcaaaatcaagtaagcgctgtttaatgcatttcctactgaatagtcaggtggtaatgacaacccttcattattcttcatatcctcaatattgttattaaccatcgtaactaactcattactcatgcttattcctcctctgacacccagtgatagcctaggcgctccatcatggtagctgtatcgacatgtaccagtaactcgtcccacattctggcttcaccaaatacatcaattagccattgccaattcggttcagtacctccaaccggatacggaatgtcaacatctgttgacccgaaagtgacgatacataacccacttagtatattggcttgcatatcagtagcccaccgtttaaagctattgttatcaatgtaatcttggaacagttgtgctttatcaaattcgtcagcgtcgtagcagaagtcatcagcatcttcgatatgatcacgttcatcgttctcaaattgccagtaatttgtgtgtaagattggtaatggctcatcagggccgcgcaacttcatgcggtcctcacttgcgttaagtgtgtctagctgttcttgcaacatcattttgcccacctccgtattaacatgaccaaccattgtcttagtgactgtttcggagtacaatagaactcgaaaataaaattagtaagcgtctttgctgcacgggtactcccaatactcgagcagcttttttcgtactcaaatttagactttggcgatactttgcgtacttccaattcgttcaacctccttaaacgtgttaaaaagactatctaactcctgaatcgtgagctgatacgttggggtgccctaaagagccttttggacccggatcatcgcaccccacatatcgcattctgaaggcttccgtgttacttgcgataacatggaggtctttttctattgcccataatacgtgtactagttgctttagtgtttttgtcatgtctcatcatctccttaaattccaaaccaactagcaacttcatgacgcttgaaccacaatgcagttaacgcgcagcctactaatgctccttcaatcattgctatttcctccttacgctcgtatttggttgtcagacatccaattctctaaagctttttgtgaaaatgaatcttttgtccccttcttgaaatgtggaaatccaggctgatagtaataaaaatcttttaatgtatccacactgcatccaagcatactagcggcttgctgttggtttaatccctgatccggtgtgtaatacttcttcaccagcacttccagttgtggcatgattctatcagctacagcaacggctacagcatcaataaactcagtatcgtcattttgcgttgagatcatcatctctatcactccttcctatgtttaacgactccatctttaaaccattttttcattcgctgtttaagctgatcttgcatcgacaaatcaaagccacgacatacatatgcaattaggtttagcaagtaaagcactgcatcaaaacactcagcgactagcttcttaggatcatcaaaatcatttggcttcaaatcctctttaggtatcgttagttcatcaagtgaatcctgaatagctgctaatgcttgactcaattctggcatcgttttaacggccattgctaatggctccttcataattcggtcgccatcaatcaccggtgtcgttactcccacgaatctgtgtgccaattcgattgcaaagaactgattttggttgggcaatgctgctaagaatgcaggaactgattcgatctgaatccgtgcttgatcatgtctttgtttgtaaattaatgttaccgagtagcctaccttgccactcaagttgatgggcgttacgctgttttgattaatggcatcagtaagcatactgcctgcatatactgaactagattgtgttggcattttctcaccacctttcagtttcatgagtttaacctgaatcaaaaacgctggataatataattaagaattaatcatctcgtaaaattcgttccggtccccgtcgtgaatcatagctatcagctcttgaagctcgtcttccgacatccaaaatgtcttagcattaatcagactcggcgacactgccgggagcagttcgatgattgaatcgacaagttcacgtttgtgatttttaattgcttgcatgttgttgcctcctattggtctttgacatctgaatatttatgggctactatttgaagcttagatttgactacattttgtagctaaaaaggtcaaaaaaaatcttttccttaggaatattgaaaaagtcttccaacttttgaagttcccgaggtttaggattcctttttccaagttcccaagcactgacagtcttttctgacactttcactaccttagacagttctaattgggtcaatccttttttcatccgtaattctcttaaatggttcaaatcaacacctcctaactacgttttgtagcttacgttaattatattaccctacgttttgtagtatgtcaacgttaaaaactctgttttgtagcatttattttaaaactctactttttgtagtattatcatctaaagatatacgattggaggggattctatgttctctgagagactaaaactattgcgtcaagaaaacaactggacccaaaaagatctagcagatagaataaacgtttcagcaaaaactattggtgcatgggaacgtggaactagagaaccaccgatggatactatcacagtttttgccaatatatttgatgtttcaactgattacttacttggcacaagtaatagccgaaaagagtctagtaatgaaattgatttaggtgaacaaatcgaggataaaaacaaaattctcaaatatcaaggccgtccaatacctgaagaagaccttaatttaattttgcgcctgctaaaaagtggtaaggatgatgatgctgagtgaatgataaatttgaagtgtttatggaacggttattacaatatgcgtttgatagcaaaattggttatatcttaacaaaaaaattggaaccttatacaccatcagttgctgttcctgaagacaaccagataattattaatatgaattggcataatcatgatgagattccattttctttagctcacgaaattggacattttgtcaacggggataccggaacactctattacacttctaacacatttatgcagaagtctgaacgagaagcaaacctaagggctttagagctaattttgcctatttatgctgacattaaccaaggtatggttcctaataactatcaaactgttatgaaccaattacagataccgcagtgtctagataatgatgtacgagttcagctttttaagatggactttcattaattaaactgatcagctaggaagtcattaaaagctagggggttagaatttaatcatcatagggaatttatttggatagatgttaatttggaggagtttcaattgaaaaagggactaattttaggaattacattgttatcacttggcttagcaggttgtgccaacacaagtacaagtagttctagccaaaataatagcgatactaacaaaacagcagctaaacatcttacaaacaaacaaataacagcaatttataacactactatgaatgctgaggctgatgtttggagtaagttgacagattcaattaaaagtaatgataacgaaatgtcagatgcagttaacagtgcagatacggtgctaactaaaaatgaagccactttaaaacagcataagagtgaagacggtgtctctgacatgtcaaaattagtgcaatattcacatacattaattgatgactacctgggacaacttaagcttgataaaaaaggaaatagcttaatttcaaaagaagcattattgagtcaaaaaataagaaagcagtttaatatttctgctccaacaaaactagataccgcaattaagagtgcaacaaaagcaataaatgcaatgccaggcatttctggcaaaacaattcgaactaccaattatacaatcacaattacttcgacagaaaccacaccacattttgagggtggaaccgacttgattatctactatacattcaaaaatacttctaagaataaaaatattgaaccaactgaatcacttatcgagggtgctcattttactcaagaaagtaaaacgtcaatcaatgacttggacctcggtaatccttcaaaggactctggtgaatggagctcgcttgaaaaagctgcgtcacaaaaagttaaaccaggtgctgaagtaaagtgtatggggagctatgaattggacaataatgaatatcctgtcaaaatccaagctactgatccagataacaatgatgccaaactgggtacaataactttagatctgccaaataactaacacttctcggtcgctaccgaatggaacacagataatctgaatgctaagtattaactataagggaagtgcacaaattggatgacaatgaacgcgaagctttaacaattatgaaaaaagcatatcaagatgaaatcgcttatattatgggtgtgaataatactgatttctcaagattttattgggcaaataaacgacgtttgaaaatgtatttcattaaaatcttcgattcttcatctatcaaaatatccgaaaaatatattttttttgctacaaaagatacatcagacagtatagaaatacttgattttgaaaaagaaacacacacttttgaatttgaaaatatttcccataataatcaaaaggttcttaattatctggtttcgaacaaatttctttcaaaagacataatacctaagatagtaccagaatctattaatattacttttttcgttaagaacttcgatatactcactcaaagtagcgttctatcaaattgtttaaagaaatttgctgatgcggaatataaaaaaactcatgaccagttaatcactcaaaataagattgaaaagtttccattaactcaaacaaaactatttgtagacacttatcattttgatcaaatgctatcaacactgaatgataatcaatttacagatgaattcaatcaatgcttatttgcatatcaaaatcaaaaatggtttctttgcgctgctggcctaggaagctgtctggaacacttgatgctcttaactttgagtaattatcacaaggaaacgcaattggggagaaatcctacggccaaagactatttaaaagcgttcaccaaagaacctataaaactagaatccaggcaacaaacattcattgatgctctctttagattacgcaattcagtagatcatcacaatagtggtattacttctaaaagaatctgtgacacgttgctcgacggaataagtgatgttttcaacgaatactacattccctcaatcaaagctttctaaaagtttgcccatgttgtttgcatcaatagcatctactgatttatatgtcacattcccgttctcatcataatcataatatctgaactcctcatcttgtggaaggctatccaattgacgctcatcccgataaaattctaacgctcgaatcaaaagttcacgttgactttttgtcatatcaaacacttcccttcttgtagagattatacaacattcaatgaaaacaacaaaagcccctcacagggctttcacgcgagcgtagttcaacggtagaacagtactcctttgaattgctaactagatactttcagatgtaggttcgactcctgccgctcgctttaaccagaaagaaggcttaatgctatggataatgaaatttcaaaatacgagctaattgccacgatgaagaaagatatacagacatttatggactcagaatccatgtcatatctaaaaaaagattcatattcaacagaagaatatgaccgtatgctgacagaagtaaaagatgatttgaaaacacggctattgcaaaaataattatgaactcagtaaatgatagtcagtcctagctgacttcacgcgagtgtagttcaacggtagaatggttcctttaattcaaatatagcctaccttccaatgcaggttcgactcctgccgctcgcatagagattcttaactcaatcaaacacaggagaatcaccaatgttcaattctttaacttattttttaaaaagcctgtcctctattaagtggagcactgagctattatttgtggcaattatatcagcattagttgcatattttctctataaaaagcttcatcactaattgattacaaacgtgggtgtagttcaacggcagaacggcaacttcttatgggatacccttcctttatttcttattgccatgcgggttcaactcctgccactcacattgaccagtcaggatgtcattaaaagctaaggatcggggttacttataatttggggagttattattactggggaataaattatattggaggatgtttaaatgtcaaaaaatgttgttggagaagacggtagaacttataaagtaaagaagccgttctataaacgagtctggttttggattttagcagtactcgtcattttaatattcggtggatctttgggtagtaaagacaattccaataccacaaataacgctgacaaaacaactaatgttaactctgaaaaatcagaatcaactaaaactgacaacagtggcaaaattacccgctctcaatttgattcaattaaaattggggatttgatgaacaacgcacaaggtggtgatacactcgacagtctgaaacaaaagtttggcaagcctgagtcaacatctagtgatacgacaaacggtgtaaagaccgatataattacatggaccaatgttgctggaggatttggagctaacgcggtggtgtctttcgctgataatcatgcgtacgataaaaaccttacgggatttaagctgtctcgaaaacagactattaagttatctgattttgacgcttttagtaatggtacaaaatattctgacttcacggctaaatgggggcaacctgattactataatgaatcgttaattagtggaagcaccactatcgttgccgggtatacttcaggtgtcaaaggcggattaggtgcgaactttaacgttactttcaccaatggagcattgagtggtaaaactcaatctggtatgaaatagcaatttataactggccctttatgggctttcacgcgagtgtagttcaacggtagaacaattatttgcacacttctcataggtctcacatcctatattgatgtaggttcgactcctgccgctcgcattgtaacaaataacccatactatcgcttactttagtacgtacatcgcgtgggcgtaattcaatggtagaataacgatttcagcccttctctctcgtttgaaattgttatgtaggttcaatccctgccacccacttttaaaagaaagaaggtaagattatggataaagatatgtcgaaatatgaactcatagataacattactaatgacttaacctcttttattaatctgtatgctttcgtttatcttacaaaagatagctactcaaggaaagaatatgaccgcataatccaaggaatggaaagagatatggttgatcgtcttaagcaaaaataattgtaggtacattctaattaactgttgagccgaccaaaacccattgttggctcttatgcgagtgtagtttagtggtaaaacgacagccttccaagctgtagtcgcgggtccgattcccgtcactcgcttagtacccctttattggggtatatattttgaactcaaaagaacatacgttcaaataattctaattggaggactgatgagtatgccacgacaatggaaacctttaaaacgtcaccctggaatctacgaatatgaaacaaaacgaggaaaaaaatacggaattcgccgttcttataccgatattaatcataaataccgcacttggagcaaatctggttttataacttggcgagatgctgatattgaattaaaaaaattcgaagtaacgcttggaactgggcaaatcactgcatcaatttcagacacaattacacttcaagcttactttgataaagttctaaaacgaaatattgacctgaaactttggcgaccagccaccattactcagaaaaagaactattggaacaatcaattaaagcctgttttcggtaaacaaaaaatcaatgaaatcactaggcaaagctatcaaaatttcatcgatcaaatgatcaaaaatggttacgccaaaaacactattattacaaccaattctgtaatgcaaatattaatgaatgatgctgcccggaatgatgtgattgtgaaaaacaagttgagtggtatctcaattgatggtggtaaatcaccgtcatcaaaaacaatcactgaaaaacagtataaccaactcatggccgtagcacctagtgtcttgtcaaagtaccaatactgcatgttagcccttctaacgcttggggaacgacgtgaagagcttatgggactgcaattcagttcttttaagttctcacaatggaatgacgaagaagtttgcgcaatacaatttaagaaggggcgtactaatgcagaaccagacggcggtgacttaaagaataactcaagctaccgcacaatatatgtacgtggtgaaatgctcaatatttgccattacgccatcacctatagtcaaaatatttattcaaagacccatagaaacattaatgatgaaagctttttatttgtaaatgaaaagacaggtatgccaatgggagtgcagcaagcaaataaggttttgaataaagtgggtgaagcagctggaattcatattacccctcacatattccggcattattttgctaccatggcactcaccaatggacaagttgcaactgatgtcatgcactggttaggccactcatctttgcaaatgactcaaagttacactcgggaaaatgttcgtggtgcacttaatgtatttaatggcatggctcctactctactaggagattcagatgatgaacaccaaagtttgtgaaaattctggtacaaaaaattatgtaccagaatttgtaccggaatcgtatcgggatgtacctgattctgtcgtaaataaaacacaaaaaaatccggaaacaccgtcattacaacgatgtttccggattaataacgttactctaagtatttgactacttaagggtaacgacaccaccaacttcttcaagcttagctttcatatcgttggcttcgtcttctgaaacgccttctttgatgattgaaggtacgttatcaacaagacccttagcatctttcaagccaagaccagtgatatcacgaacggccttaatagccttaaccttttggtcaccggattcagttaattcaacatcgtatgaatccttagcagcggcagcgtcgccaccagcagcaccggcaacagcaacaggagctgaagctgagacatcgaattcttcttcgatagccttaactaagtcgtttaaatctgagattgaagcttcttttaatgagtcgataatagcatctttatcaaaagccattttttgttcctccattttatatgaacttatattttagtttttttaacacactgacagcaaattaagctgcgtcttcgtcgcctttttcagcaaccgccttaacagcgtatgcaacgttacgaacaggtgcttgtaacaagttggcgatcgtagccaataattcttcacgtgatggcatcgtagcgtattcttgaacagtttcaagatcagcaactttaccttcgatcacgccaccctttaattgaagggcatcagcggtcttcgcgaagttagccaagatctttgcaggagcaactgggtcttcttcagagaaggcaacggcagtaggaccagcaaatacaggttttaagtcttcaaatccggccttatcagcggcacgcaccatgatcttgttcttgataacgcgcatcttaacaccggcttcacgtaattgcttacgtaaatcagttacttgttcaacagtcaaaccacggtaatcaacaacaatggctgatactgagctcttcaattgttctgcaacttcttcgacttcttgtgctttaacagcaattgtttctttactcaacagattcacctcccagaattttggttcagggatttataaaaaaatccctatgtccaccaagacatagagaaaaaacaatgtcctcggcaggtagattaaggccgttaagccgcctgagtcttaggtagagatattacttaacctctagtaatctatcacagatcacccacggggtcaattgttttcagaatttaatccttaaaatgatgctaaatcaacacgtaccgctggggtaaaggttgaagtaacaactaagttttggatgaaagtcccacgtactgaggctggacgagctttcacgatggtgtcttcaatggtcttgaagttaccaactaacttgtcagtatcgaatgataccttgccaacaggaacgtgaacgttaccgtcacggtcagtccggtaagtcaccttaccagcttttgaatcgttaacggctttaacaacgtccatcgtaaccgtaccagtcttagggttaggcattaagcctttaggtccaagaacccgacctaaacgaccaacttgggccatcatgtcaggggtagcgattgcgacatcaaagtctaaccaaccgtcttggatcttctgaactaaatcagtttcaccaacaaagtcagcaccggcttcttcagcttctttagccttgtcacccttagcaaaaacgataacggtttgatctttaccggtaccattaggaaggacaaccgcgccacgaagttgttggtcggcttgctttgtatcaacgtttaatttgaaggcaacttcaacagttgcatcaaactttgcgaaatccatttttttaaccaagtctaccgcttcagttacatcgtaagctttgtcacgatcaacgagcttagcggcgtcttggtattgtttacttttctttgccatctaagtgttttcctccttgcaaatgtggttcaaacggagatttcctcccacttgacacattcattttgatgaagtgtccgacatactcaacagtactgaattagccttcgacggtgaatcccatactccgagcagtaccttcgatcatgcgcatagctgcttcaacgtcagctgcgtttagatcttgcattttagtttcggcgatttgcttaacttgatctttggttacagttgcaaccttcttcgtgttaggttcaccggaaccactttcaacaccggcagctttcttcaatagaacggcagcaggtggggtcttagtgatgaagtcgaatgaacgatcttcgtacaccgtaatcacaacagggatgatcatacctgcttgatcagcagtacgagcattgaaatcctttgtgaaacccatgatattgatacctgcttgacctaaagctgggccaactggcggagcaggtgttgctttgcccgcaggaatttgtaatttaacaacgttagctacttttttagccacgagacattcctccttagtccgtgatgtggtaaatggagctgagtttttgctcctcccacgtaaacgtgcatacgtgacgcacaaacatcattgtagcatatctatttttcaccagcaaccttttttgtggcttctggatataaaaactggacgatttggcgatcaacttcatagttttcatgtaatcgtgaatggcgggcattcttaccatgtaccacaaattcttgatactggtcacgcgtcggtcgcagtaaaaagcgcaatgacaacgcactattcagagcgacagcaccatcactttgcgccgcatcgccaatgttacccgcaatattcaaatacgaaatcgtgtttggcaatcgttggagcgttcgcaaaaaataattataaacgggcgtagtcttagttggtccggtcgccgtcaacgggtggttttcaatcggatacgtattttgcccgacctcactatcattaaacggcgcaccaattgtgacaaccttgcggacttccggtaaattgaccagtttggcagctgtcgtcaagtattgaaagagcaccacaccacccatcgaatgagcgactaaattgatcgtctgaacgtgctcatgcgcaatcaaatactgcacaactgccaagacgcccgccgcctgttgccgtacagcaacgcgtggcgtggcaaaaatcaactgtaccattgggcggtaagcgtctagctcaccagtcacatggggatgattatgtcgatcaatcattacgactaatgacttattggcgatgcccccggccgtaaaacgttggagcatgccaccaaaagagaaccggttgcccgcataccctggaataaatagcgtcacggcgctatcatctgctgaattagccgacaccgactgccgcaaatgctgcggtcgcccgtattgccaaaatttaaaggtgatacgccccaaaataccgagcactaaggcgccgatgatgactaaaattacttctgccaagatggtccaccagcttacttaaattaattaccgaatctggtcaacttgatcgaagtccaattcagtacttgtttcccgaccgaacatattgatattaaccttgagcttcatcttttcgttgtcaatttcagtaatttcaccagaaaggccagagaaagcgccatcgatgatggtaacttgttcgccaacttcaacgtccaattcggtatgccgagcactcatgcctagttgatgcaagatttgttccgcttcttcaggcaacaatggcgttggtttactaccttgcccatgtgatcctaagaacccagtaacacctggcgtattccgaacaatataccaagcttggtccgtcatgaccatttcaaccaaaacgtaaccagggaagatcttcttcatttcaactttgtctttcccattcttgacttcatgagcttcttcttcgggaacaacgacccggaaaatattgtcttccattcccatagattgaatacgggattccaagttagaactaaccttattttcataaccagcgtaggtatgtaagacataccatcttttctcaacagactcgaccattattattctcctttaaaatgtcttttggcaaaataaaaaaacctcgtttgcacgaagttttctttcaatgccattattataacaaaaatttgttcaaaaagccattaatgccagcttgttaacatttgtaataataattggataatccaatcaaataaagcgaaaaacgccacgaagaacagtgatgttgagacaactgtccacgaatcacgacgattttcccgccaagttggccaggtcacttttttcatttcatgtccaacttgaccaaaaaatttaaataagcgcatgtctaatccccctaccgcgtttcacgatgaagtgtgtgtttaccacaatatttacaaaatttcttaacttctaagcggtcagttcgattcgggttagcatcaatcgtgtagttccgcgaaccacaaacggtacatgccagtgcaacttttttctgtgccatcgacaaaacctccataataaatcaggtataacattagcatggaacttttcgaatgtcaatttcaggcagcgtcttgtaaaaagtcacgcatcttcttgcggcatcgatccgtggcgttgaccacttgatcaacttccacttgccgactcaatgcaatccgttctggcgattgccctgccaatagatccataaaaaccaatccttcaaatgccgaacagattgctggaaaaatccgcacctgctcacgaacatgaaccacatcaagggtcgaggcccttagcgtctgaatattgcataagatatcctcatcattaacatccagtgataagatatccccttccggacgacgcttgcgagcctgtgtccgccgaatatgatcaataatctgattactcaatagcacccggtaataagtgccaaagctacattgccgtagccgttgatactttttagccgctcgataaactgcaattcgaccttcttgaagccaatcatcctcgtcaaagttccggacatagtattgccgccgcaaccgccaaacaactggcacatactgctgggctaatgcattaatgcttgcatcatcaccatctgctgctaagtggatcaattgctgttcattcacgtgacattcctcgcttctgactagtttcagaaactgcacccctgagcatctgtaatgctaatataccgggttaattgtgccgtcacaagcgaacgaacgtttcaattcagccacctcagcactcacagaaatcctcttatacgcggctatcaaaactactatgatcgtcctattcatcaacctaatagtgccatatcgcactaattattagtaatatcaaaatattgctaacgccaaagacaagtgcgacctacttaagcccgttggcgacgagtacgcgcgtccgctggagttgcaagaagccactgcgctgtctaaccaaccgattaatgcaatcgccagcgcaaactccgataacaccaaaactgttatgacaagccatcctaacatctagtgaacagcagctgaactggggcatttgattactagatattttaatactagaactgctttcgagccttaaattgccactggttatcttttgcaaaatttaaatattaattatgacgatttagaaacaacccacgctcgcggcaaccacctaattacttgtgatgatgtttaatgtgattgcgttctagttgttggcggtactgatccaaggccgataattgatcatcattccagggtgatttacgaacggcacctaaatcctgggtgcgcacggcagtatgacgcacatctttcagcgcagtcttgacgcggtgtcgtaattccaaggctggtactcgtaatgcaccttccgaaaagattacccattgttctgcctggtcactagtcgcaaccgtcacttgaagtactcgcgattgcttttcacccgcgtacttttcgatataactgtcagcggtctggtctttactcgtccaaataatctcaagatcagcttggcgataactcttagaattacccggaacgtacatcgcatcaaaaaccaggctaatattaaggcccgtaatttttttatactcagtcaacatgctaattaactcgtcacgagcttgcggcaaccggtccgtttgttttaaatgattgagttctggccagttgccaatcatattgtaagcatcgacaatcaataattgttgtttcatcttattttcccagtggatgccgggacgtgtagccttgataaatcagaaggctggccgccacactggcattcaaactttgaacatgaccaatcattggaatggtcaacatttcgtccacactcttcttaagtaatggtgaaattcccttaccttcattaccaataatcaaaccaacggcaccggaagcatcccactgtcggtagtccgtcccgttcatatcagtcccaaagatccacagaccggcttcttgcaattgtttaaccgtttgaaccaagttcgtcacccgcgcaactttcacgtgttcgatagcccccgttgacgtcttggcaaccgtactggttaaccccacggcgcgccgtttcggaataatgatgccatgggcgccagctgcatcggccgtccgcataatcgaacctaagttatggggatcttcgatattatccaagatcaagaaaaatggcgcttcattcttagccttagcaacagcaaataaatcatcaatggtggcatattcaaaagcagccacccccacagctaccccctgatggttggcgttgtcggttaaacggtctaacttttgtttcggcacgtactgtacgatcaaattacgtttcttcgcaatcttggcaatgtcattcagtacatcggcctgtagaccgctttgaataaagactttgttgatctgttgatcactcttgattgctgccatggcggggtgccgcccgattacaaagtcagctgctgtttggtcttgttcgttatttgacactggaaaccctcccttcatcaacttgtttaatacaccactgtgccagttctgcaattcggtccgcctgctgagtcaattgtaaatacccaaaaacggcttcaaaaccggttgagatccggtaagtgacgacatcggtatgtttggccgacgtatgactcttggcattccgtccacgcttaaaaacgtccacttcagttggcgttaaaacttcttcggcctgcatccgttcgatcagtgccgcttgcgctttggctgaaacatagtgggttgcgtggtggtgcaacttagtggctttagtaaaaccactttcaatcaaatgttggcgaataaacggttcatacaccgcgtcaccgaggtacgcgagtgcaatcccgtttaattgttgataatcaacttgcatattattcctttctaaaccgcacaccctgaggcgtatcttctaaaataatcccctgaactttcaaatcatcacgaatctggtcggccttagcaaaatccttagctttacgagcagcttctcgttcatcgatcagtgcttgaatcgcgtcatcagccagcgtcgcattagccgtttcaaaagtgacgccgaagacgccagtcaattgcactaatgccttctgtaaggcaatcaacgtctctttttgaaccgttgccttggctgcatagacattggctaacttagctaattcatacacagcagccaccccgttttgaacattgaaatcgtcatccattgcggttccaaagttagtgatgagtgtctgtaactgttctgccaccgcagtatccgtcccgttcgtcgcatcttgcaaccggaacgtgagattacgataagcattacgtaacttatccaagttattagctgcttcgtctaagttggcctgcgtatattgaatcggtcgccggtactgggtcgtcgccatgaagaaccgtagcacttgcggatcaaccgttttaataatatcgtgaaccgtcacaaaattacctaatgacttactcatcttttcgttgtcatcgccaaccgtcacaaaaccgttgtgtaaccaataattggcaaacgtcttgccggtcttcgcttcactctgggcaatttcattttcatgatgtgggaattcaaggtcctgaccaccaccatgaatatcaaacgtatcgcccaagtacttagtagacatgaccgagcattcaatatgccagccgggccgacccgcaccccatggcgattcccatgaaatttcaccgggcttggctgctttccagagtgcaaagtcaattggatcttctttacgatcggtttcttcatcggcagtatgctgactggcacccacttctaaatcatcgattcgctggtcagataactgaccatactttttaaacttccgtgcgcggtaatatacgtcgccagctgattcgtaagcatagcccttttcaatcaatgcttgtacaaatgcaatgatttctgggatattctcagaggcccgcgggtgaaccgtcgctggttcaatattgaccgcagtcgtatcttccataaaagctttaataaaccggtcagcaactgctggtaccgtggtgtgatcttcagcggcacgtttgatcagcttatcatccacatccgtgaagttggagacatagtcaacgtggtaaccgcaatattcaaaataccgtcggatagtatcaaaggcaattgcagaacgcgcattaccgatatgaatatagttataaacggtcggcccacagacatacattttcacgactccgggggtgataggcttaaacggttctttttgacgcgttaacgtattaaaaacacttaacatattggcgacaactcctttcaattgaatcattacttttgatgatagtttaccatgtttgaaacacaaataaaaagcatccctcgcacggcggaaccgaaactccaccatacaaaagatactttcatatgcagtcacgcgccactgggtaactttcgcgatactgagataacgctcacccggggactagcttgctgaccgcacgatgtattaattgcgttgtcttgctgacgacgaccgccacttacgacaaccaactaatattttaataatccattcattacttggcgagttccgcaatcatagcatcgagatgcttcttggtcgtttcacgccctaataattcaatcgtttctggtaattctggcccgtgcatttcgtgagaaacggcgatccggatcggcatgtataatgcccggcccttgatcttcgtatccttttgaatgctcttgatcgtcttttgaattgcggttgcttcgaagacgtcaatatcttcgattcgttgccggaattccttcaagacagggagtgccgtgtcattatcaagttcggccttagcttcatcattgatatcagccggaccattgaagaagagatctgctaaatcaacgatttgaccagtatagctcatctggttcttaaataatgaaaccaacgtccgtgtccattcaatctggctcatatctgggcgttgtggtaaccggccagccttgatcaattgacgaattgacattgcaaagacttcattttcgtcagccttcttaatgtactggttgttcacccattccaacttcttgccatcaaaagctgctggtgacttgctcaaccgcttttcatcatacattttgatgaattcgcgcttactgaacaattcactttcgccaactggtgaccatcctagtaggatgatgaagttaagcattgcttctggtaagtaacccaattcacggtattgttcgataaattgcaatacggtttcgtcacgcttgcttaacttcttaccggtttcggtattgataattaagctcatgtggccaaacttcggtggttgccaaccaaaggcttcataaatcatcaattgcttaggcgtgttggcaacgtggtcatcaccacggaagacgtggctaatttccatcatatggtcatcaacaaccaccgcaaagttgtacgttggcatcccgtcacgcttcttgatgacaaagtcgccaccaaccgtcttggattcaaacgaaactttacctttaaccatgtcatcccaagcataggtcgtattttctgggacgtggaagcgaataacgggttggataccagccgccttagcagccgcgatcttcgcctgtttttcgtcttccgtcatgccagcaaattcgtagacgtagtgtggcatttccttacgcgctttttgagcttcacgttgtgccgacaattcgtcttccgtcatgtaagattcgtaagctttaccttcatcaattaattgttgaatcaacgggtcatagattgatttccgttctgattgacggtaagggccaaagtcgccacccttatccggaccttcgtcccaatcaatccctaaccacgtcaaattgtccatctgactcttttcaccgtctttaacattccgctttaaatcggtgtcttcaatccgaagaatgaactttcccttattatgccgggcaaataaatagttaaacaatgcagtccgagcattaccaatgtgtaaatggccagttggacttggtgcgtaacgcacacgaatcttgctctttgccaatgtgattaacgcctctttcgtattttttcatcttaaatgttacgccggaacctttctatcgaccagaatattccgactttcacttgcttttccagtttaccatgtttaccgctaaaaattaaggtttcagactgaacccattgtaaaaatatcgaaacaggccctaatcgtacactaacaacatcccaatttattgataatgagcattaaccctcctattttgttgcgattcggccgcctcccttacgacgtcctggattagtcatcattgaacaaaaaaacggtagcccccatcaaatgagttgctaccgttgaatcgcttaacctagtgccgattatcgcgattattatttcgattattactatgattattgttgtgcttattatttccatccgcatgatccgggattccgcgattagcgtgcgctaaacgggcaaaaatcattcgaccagcatccgtttgtaaggcgctcgttacaacgacatccaccttttcattgatgtaaaacttcccatcttcgacgacaaccatcgtcccatcgtccaagtaaccgaccccttgttggcgttcgctaccatttttgacgaccatgacattcatctcttcaccaggaataacccgtggtttcaacgacttagccaactgattaatattgaggacttgtacgttttggaactcaatcaccttattcaagttgtagtcattcgtcacgatcacaccgttgacttttttagccaattgaatgagtttactatcaacttctggaatatcctcaaaatcgccctcgtacatttcaaccgggataatattttcattttgtagcttatttaaaatatctagcccgcgacgaccccgcacacgtttaatactatcagctgaatccgcaatgtactgtaattcatacaagacgaagttcggtactaacagtgttccttctaagaaaccagtcttgacaatgtcgtaaatccggccgtcaatcaagatgttggtatctagaatcttataatgatgatagttctgatctggctgagcatcagtaatctccggacttgtttccttttcacgacggcggaagttgaaaactttccgccactcgtcgatccgggtagtcccgactcgcgcaccaatgtaaccaaaaaacaacatcaaaataattgggacgaccgtgttcaataggaataatggactacgattaaataattgcgaaatcagaaccgcgatcaataacccaataataaatccgatactgccaaataaaagtgtcattggattttgcttggataagttcttttcgactcgatccaccagtcgtacagcggcattggctaagaacaatgacaaaacccatagaatcagcgcccccaacaaaaagttggtaaaaacgttattcaataacacatttggttgcgacaaaattgtcgtccacaagaacggcaggtaagttagtcctaacgtacccccgacgacaataaatactagtcgcaccgttaacttcttcatggcatcagcccctttttaataatttggttgttgtaatgctaattggagcgcttcttttagcgtggcaactccaattacttcgattccagttgggatatcccaaccttgcagattattcttaggaataaagatacgtttaaaacctagcttagccgcctcaccaactcgtgattcaatccggttgacccgccgaatctcaccagtcaaaccgacttcaccaacaaaacagtcactcggacgagtctgctggtcacgataactagaagccacactgaccgcaatagctaagtcaatcgccggttcatctaacttaacgccaccggccgctttcaaatacgcgtcctggttctgaagcattagactcgctcgtttttccaacactgccataatcaaggagactcgattatgatccaagccacttgcggtccgcttcgcattaccaaagaccgttggcgttaccagcgcttgaacttctactaagattggtcgtgttccttccattgaaacaacgatggcggaacccgtagcatccttcagacgttcttccaagaagatctctgacggattggccacttcatacaaaccgcccgtccgcatctcaaatattcccagttcattcgttgacccgaatcgattcttgactgcccgtaaaatgcggtacgtatgatgtaaatcaccttcaaagtacaaaacggtatcaaccatatgttctaagatcttaggccccgcaatggcaccacccttagtcacatggcccacaataaaaatggtaatgccgttagtcttcgcaatttgcagtagttcagccgtaatttcacggatttgtgatactgaaccaatcgcagagtccatatcaggttcttgcatcgtttgtaccgaatcaatgaccacaaattctggatgcgtcgattcaatcgttgaacgaatattcgacatatcagtctcaggataaagataaaagtcttcactgctaacagccagccggtccgcccgcatcttcacttgggaggcactttcttcaccagtcacgtatagtacggaaccacccgtctcggccaattgccccgaaacttgcagtagtaacgttgacttaccaatacctggatcaccaccgatcaaaactagtgaacctggcacaacaccgccacctaagacccggttgaactctttcagcttagtcttgacacgcggtgtcttagtcagcgacacttctttgagtcgttgtggcttagccgacttacccgcaaagctcacccgcgacttgcggtccggttttgtatcaaaatgttcttcagttagtgtattccattcaccacagttcggacaccgtcctaaatatcgcggtgttgaataaccacagttagaacaaacaaactgagtttttgcttttgccacgtacacacgtctccatttctccgccaacatatcaatttaatgttgggtattggaatttctaaaataattacttcatccgcgccacactgtcatgagtcatgattaaaaggtgccaattagatagatttctgttcgtcagcaatgactatcctattccgacctccggggctgggtgacaattgctggaacgtaagccgacgtcgatttgagctaacgcataacccgtgtcatctcaaatacgagtcttattctaagccggaagaaagacacttccgcctaagaataatttggctactgagcattgtcacccagcccctccagtcgggaagccgctcgaatggcaaatgaacggccgcttaacttggtacaattggttgctgactactttgatacgaaaactttgagcgaaacatcagaatgtattctctactttgtcgaaacgttcaatgtattatgactggtaactcagaaatagtaagtcatcacaacatcattttcagcctgacagttgattgagaaaattgccgtttatgaaaaacaacgaccaattcatcaaaagttgggtacatcttcatcagctattcgaataccatcccgactggaaggtgtttctgacaatgcccagtactgcaagagtgtgaggttcagatgagttgagactgaggattagcctagctaggccgttaagcggtgaattcccgcttggcgtcatagcgtagctaaccggaagtctcagtctgacccgaacacgtttcaccaatatggcataaaagcgtgaaaggccagtatttaagacatgggcttcggctcaaatctgtgcccaccgcgttccggcaattggcagaaatatctggaggtcggtgtaggacgaattaactaagcaagtttacgctaactcgaactgtttccagcgaacctaagctggctgcttttaaatttaaaaaaacggcaccttttaatcatgattcttactaaacaaccagccagcacgatgcagacttaaataatcaatcaaactcaattaactggatcgtcattttcatgctatgggtataagtttattttaccattattaatcattaaagcctttaaatcaccttggctttaccgattttttattatttcctatttattggtcgaaccgaagcccccagaacgtgtcgttgtcacattcgtttcatccgtaacagtcagataaggggtaaaaatcccttgggcaatgcgttcaccctttttaatgtgaacgtcgcgaatccccatgttgattaattggacgaaaatcgcaccttcgttcttgggattgttatagtagtcggcgtcaatgacgccaatcccattcggtagaatcaagttacgcttcaaggggttgctggaacgattggctaatagtaagtattcaccttcattcataaatgccttaatacccgttggaacaagccatggtttaaggactttagccgccgcatccaaatcggctgcagaactcgtttcaccatgatgtatttgccaaagtactttgataaagttcattttccaaattgacggtaacgtaaaatcttccgccgcttcgaagtcatagccagctgcttgcttggtggtgcggtaaggtacatgtaaccccgcctgcgcgtattgacttacaatttcaaatccccgtgccatttcaaattcctactttctcaacattaatttagtgttcacattttaccatacttttattatagaagtttcgttgacaaaacgggcaattaccggtttaattacggtagatataaaaccctttacaaggtggtgaaatcaatggaattcacgcgtgaagcacaccgcttttattttaatgacgatcacggcaagttggctggtgaaattaccttccccgccatcaataatgatcagacctgggtcattgaacatacctttgttcgtgacgattttggtcatcagggcattgccggccaattaaccaaagccgttattgacgccgctcgagttgaacacaaacgtattcagccactgtgtacctacgctaaggcttactttgatcggcaccctgaagctgccgacgtattagtcactagttctcaatcaaaggagtaattcatattatgaatcaggatcagttaaaacaacttgttggtcaaaaagccgttgaatacattcaagacggcatgcaggtcggccttggaaccggctcaaccgttaaattcatggttgatgctctgggtgaacgggtcaaaaatgaacatttaaacattgtcggcgtctcaacctccgaccgaaccgctgcccaagctaaggcgctcggtatcccgatgaaatccgttgacgaagtcgaccatctcgacttaacgatcgacggtgccgacgaaatcgccgatgatttccaaggcgttaagggtggtggcgccgccttactcttcgaaaaaatcgttgccatcaattctgataaagtcatgtggattgttgatgaaagcaaaatggtccatcaattaggtgcctttggcttacccgttgaagtgattccttacggcagccaacatgtctttgaaaaaatggctgcccggggctataacccagtattccgtaaagtcaacgatgaactcgtccggaccgattctaataatattatcatcgatttacacatcgacccaatcacggatccccacgctttagccgaagatttaattcacatggttggtgtggttgaacacggcctgtttttagacatggtcaacactgtcattgtcggtcatgccaatggtcccgaggttatcgaagcgcgaccatagttttgtgtgactccccgcttgccccacccgtcataaaccgatacaattagaattagattaaaggagagtgatcttttgagtaaagcaatcagtatgaaccaaattgctaactttcaagccgacttggaccaacgtcccgaagcaaaagtcatcgaacgtagtgtcactaagaacggtatcttagcaagcagtcaagatattcaggccatgagccaaaccacaccagtattttccattgatttggatacaggcgacgttgcgaaccaaaagcaaagtggccgttgctggatgttcgccgctttaaacacgatgcggcattcattagctgaaaaattcaacttgaaacatttcgaactatcacaaaactacacctttttctgggataagttcgaaaaagcgaactatttctatgaaaacgtgttggcaaccgctgaccaaccaactagcagccgtaaagttgcctggttgatgaccacgccacaacaagatggtggccaatgggatatgctcgttgccattattcagaagtacggtatcgtgcctaagagtgtcatgcctgaaacttacaacagttcaaaatcggctgaaatcaacagcacacttaacttaaagttacgtaaagatgccgttgaattacgtgaactagtggctgccggaactagtgacgacgcgattcaagaacgcaaggaaaaaatgttaaatgaagtctatcgcatgttagcctatgcctttggcgaacccgtttcacattttgactgggaatatcgtgatgataagaaacaataccacatcgaccaaaacttgacgccacaaagcttcttcgaaaagtacgttggctggaatttggacgattacgtttcaatcatcaacgccccaaccgacgacaagccttataaccatacctacacgattgaaatgttaggtaacgtcttaggtggccgtgaagtcaaacatttgaacgtgtctatggccgacttcaagcaattggccatcaagcaattacaagctggccaaagtgtctggtttggttgtgatgttggtcaatcctccgaccgccaaaaaggggtcatggctaccgatgtctacagtaaagatgaattattcgacgttgacctttcaatgtcgaaggctgaacgtcttgattacggcgaaagtctgatgacccacgccatggttatcaccggtgtcgacctcgttgacggccaaccaactaagtggaaggttgaaaatagctggggcgacaaagttgggactaagggcttcttcgtcatgagcgatgcttggatggacgaatactgctaccaagttgttgttaacaaggaattcttgtccgatgacttaaaggcagcccaagccgaagaaccaactgttttagcaccttgggatccaatgggtgcattagcctaattaagtttaatgggccatctaaattaagcaccatcactgctttagcgtgatggtgctttttggactgcattagacttaactaccgctcaaggaactactaacaacaaacaataaaaaaatcgactaaactcacgcgagtttggtcgatttttttattattacgtttacttatagcaatcactattataattatttatacatctgtttaagcgtactaatttcacgagtcgtaatatgtgctgctcgatgcgactggtaatacatcaccgcactcttgttgttctcgtgctctagtcccagtgcatgtcccaattcatgggtcgcaacggacagcttatattctaccgaatgattgctggctggaaagcgattcgtgtaaatcacacacttcgccgaatccatccaagttgttccttgcgaaccactttgatagtacgtccgccaagtccggccgatttccgatccggtcgtctccgtctcgtcttcactctcgcccaacgtaatctgggctttcgcttggtccttagcctcaactaacctcaccgcgttagtgttattccaacgttccacggctcgtagccaaatcgctcgatacaccttgctgtcactcgtgatccgatacgtgatgacccgactcttaaaacgggccttatagttcaaaaccttagtcccgttatttatataatcatattgatagttatccatctgatcattgtagtagacctgatcatgcgtcgtatcgtgaccactagccttatccgcttcaactcgcgacgcattcgggttgatcagcgtactgatttgtggcgcgaacatcaacagcatcccgcagaaacccaagctcattataattaataataataaatttttatgtttcatcataacgttacccggctttctgatcagatttttggctgtcaagcgcgccaaatcgcaactttgtccaactgatatgttacagcgttcaccattctattacaagttatatattatatttatttatgaaaactgaaggattttattacattaaaaatatttatattaactcaagcagttgtgaaagcactgttatatcaactttttaagcctgtatcattttttgagcactcgtcggcaattattatcaatgattataattacttatactgggcatttatttaacactttaactaaaaaaaagcttcagcgtctgctgaagctcttaactcaggctcgattaatctgataatggtctaaaaaagcagtccagattagcacttactttaaataaaagtaccgcttaggagaactattactaaatttaatactcttctttaccgataacgtgcagttgccgatcaaggtgataacaaattggcactccgttagcaacttcgacaccatcaatcccagtatcactaatatgctctaaatatttgatcatcgcacgcaacgtactaccatgcgccaccacgagttggttttggccgtctaacaaccgcggtgcaatctcatcgatccaataaggcatgatgcggtcgtaagccatcttcaagctttctccccgcggttcgacggcggcaccgtacttggtgtaacgtcgatcatggtctagttcagctggtgtcaacaacggcggcaccgtataaaagctccgccgccactgttgaacttgcgccttaccgtactcttgacgagtcacatccttattttgaccacgtaaggcaccgtaatgtcgttcatttaaccgccacgtcttatactcaggcagccataactgatcaatttcacttaacataatattcgcggtaacgatagcccgttttaggactgaggtatgcacagcgccaaactgcagtcccgtagctcgtaatcgcttgccagcttgatgagcctgtgcaatacccactgctgttagcgggacgtcactccaaccggtatacgtattatcccgattggccgtactctcaccatggcgaaccaatactagttctgtcattctctttcccacctactatcttcaatacttcctatgataatcgatttggttcatttttcaaagtcacaaccagctgttacgtgcgataacgcgcttgccacaaaaaaacggtcaagctgattaatatcaccctgaccgtccacgattaattaattttcttgatttgaaacggcgtgcgcggctttgatgacatgttcatcatcagtggcggccgctgttggctgctcaatcgcacccatcgtatcccgttcacggaaccgattaccaacaaaggtcacgacggaaccaatcaaaatcacaacaattccgaccactgtcgtccacaaaatttgttcatggaggatcaacgctgctaagattggcgccaaccccggcttaatgaagaatactagggaagccgttgaaacatcggtttgttccattgccaagaaataaaacgcgaagcccccaccagtaacacaaacgccgataaaaaatagtaaccagaaatagttgagattaacattcaccaaaaccggaatggcagcaaattgccgcaaaccgatggccgtcaacccattggcgacagccggaatcttagtaatccaagctaaaactagaagttcaaacgcaccagcaaagaaagtaaaacaagtcatcgtcagcccattcaagccccgtttaacagacccataacgcgagatgatactgtacagcccaaaagtcacggcagacccgatggctaatagcagcccgagcccattcgtcaaataggccggattaacaatgatcaacaacccaatcacagaaatcacgacggagatcaagttagctcgacccaaccgttctcgcagaattaaataggagaataatagcgcaaataccggattacaactaaacaatacggccacagtcgaagcttgatcgaccgtaatcgcgagttggtaaagcgacatactgacaatgacacacactagcccggttaaagcaaatagccgccagtcagcactcactaactttcgtccggtttgctttaatgcccgcaatgcaaatggcagtaacacaattgccccaataaaaaatcgaattagattcaattggattgggttaaaggcactgccggccatctttagcgcaatttccatcgaactaaacattaaggtcgaaattgcaatgtaaagatatgctttcttcacgaaacgttcgcttccttcttaatcaaaatttaatacgcaacggttctcagtatagcaccattttcacgtgattttcaaatcagctcagtatactacctcgcttttatccgcgggaaaacgccttttaacgcggaatcaggcgttatttttttcaatttttaattgcttttgaaaacaattttcatcaggcttgaaccattcaatggcatcttgccgcctcaaccatcatccagcacgcactcatcagcttgtcatcaaaaactaccagcgagacgtgttgggacggccctgagcagaaagtatctaattggtcaaaccttgttgaccgaactaaattgagttttcatcattaacaaccagcaaaaaagcacccgcaacgcctgtcactagcggcacgcattcgggtacttttaattttaagtcacacaataattaacgaataaaattggcttgaacgatcaccatcaaaatcggaataacgatcaggctcaatagtgtcgtttctgtcaccatgaccgcggcataatcggcatccgccccgtacagtttggagacaactggcgcgttcgtcatgacgggcatcgcggactgcagaatgaagacttgcttcatctccaatggaatcgacattggaataagcatcagcgtcatcagtaccggcgcaaggataaaacgcccaagtaaaattcccaagctatcccggtcgaagcgcatgctgcttaacccggcgttggccattgaaatcccaataaagatcatggacagcggaatcgttagaccgccgatatatgagaaatcatccatcaagaattttggaacgtgaatgtttcctagaacaagcaagacaccaatcataaatcctagtaatggcggtgagaagatcttggtcagtgtctgcttcaagtcaaacttagcggtgccagtaccgtcacgttgaatcaaataaacgcccagcgtccagaaaatggtggtattggccatgtaataaactaacacgtatggcaatgcgctattcccaaacaaggcttgattaaccggtagcccaataaacaccgtattggagttcaaaaacatggaggcaaataagccgcgatgactctttttaatatttaaggctcgcatcaccccgaacgaaatgccaaacaaaatagccatattaagaactggaaaacgtaatcctggcaacgttgataataatttatgcgctgtaaactgctttgtgatcgttgcaatcatataggctggtagcgcaatttgagtgaccaatcgggcaatcagcttagtcgcactttcattaaaccagccccagcgtgccaacaagtaaccaactgcaatcatcacgatgatcgtcatgacaccttgaatgctctgcacgaatgtctgtaaaatttgcacgctcagtcttcccctcttaacaaattgctcatcattgaatatcgctatcaagctatgtaaaataataattcaatgagaattattcaagtataccactgttttatgatggcttgtaccgtaatttatagatggaaacgtttgacgccggtcacaatattacttatagtgttctataattgtgttactactgatgccagtaattttttgattattaaaatctttttaaattactaactttaaggaccaatgatttgctaaacgtcataaaatgactattgagggaaaaatttaaagtgatgaggaacgaatatgtcagaaaataacaatgataatgaaatgggaccacgccaacgccgctatcgtgaacagcaacagcgtaacccacatttgaaaccacacaaaaaacgtccttggttaattactttactaatcgtcgttgtcctgttgatcgttacgggtggctggtggggctacaagacctggaatgccgctaaggatacgatgaatacgacctaccagtcgaccggctcgaccaagcttcggaatgttgatgccgttattaagaagggcaagccattctcgattctactgttgggaactgatactggtgcactaggtcgcggcaaggacttctcagcccggactgataccatgattgttgcgacaatcaatcctaaaaaagaaagtatgacgctcactagtattccacgggatacgcaagtgatgatcgatgggcaatcacaaaaaattaacgcagcctacaccattgggggcgcaagtggtgccgtcaagtcagtagagaagttactggatgttccaattgacttctacgtcttactgaacatgggtggtttaaaacagatcatcaacgcgatgggcggcgtgaccgtgacacctaagctgactttcaaatacggtaatgccaacgttaagaaaggcgttaagatcaaacttaatggtgcagcggcacttgattactcacggatgcgttatgacgatcctcagggtgattatggtcgtcaaaaacggcaacggcaggttattatggccatggttagtcagtctaactcacttgggtcaattgccaatattgaaaagattacgaaaaaactcgctaagaacatgcgcaccgacttaacttggaatgacatggtcgcactcgatacgaagtacaagaatgcgtctcaccatgccaaatcatataccgttcaaggtactgacgcgacgatcgatgggctctcttatcaagttgcctcttcgtcagaacgttacaagaattcgaagcgcatccgtaaagcgctgggactctcaaacagtaatttaacagagtcagtcttctctgagacagcttcaattacaacgggtagctcaagttccagttcaagttcatcaagtaccacaacgtctagtgataccactacttatggcactagtacgacacaagatacaacgacgcaggaccagaccacgactcaagatcaaaccacgactaatcagtactaagcaactattaaaaaatgggtttcttcagaataaaaattctgagaagcccattttttgatgattatttttaattgaccggccaagattgtaaaaagtgttgaaactttgcttcgcgctgttcaattagatccggtgccggcaatgcttctagtgcggcaagttgggtctcaatcgcctggttgatcgcagcgactaatgtctgatcctgatggtcaataaccaggtcaactaagccgcgcgactgcaaagcgctagctgtcattggtaataaatcgatggcgtcactgctggtctgttgcccatgtaaaatcgcggtgactgcctcgggagaagcaacgttgaaaagtgcatcatctagcatgataatgcggttggcgttggcaaaggctaacgccccaccgctatggccctcaccgagaaatacaacaacgttcggtacggtcagctgaccagtcgccgcaatcaagtccgcaatggcctgactctgaccatagcgttccgactggggactcgcatcagcacctggcatattgattaagctaacgaccggccacccaaatttagccgcatgggttacgactcttaacgccgtgcgatagccgggaacagttaatgccccccccgttttttcgacgccggctcgcaatatcaacaccccggtcaacgcccagaacagctaattggcgaccagtagcagtgcgcccaaagcccgccgtcaaagccgcatcctgacctaataaacggtctccccgttgttgcgtcattgtcggcaataacgcttgaatgatagtcggcgcactgatccgatcagccgcccgtaatcgctgtaatcgtttatccatgggctgacctcccaatcccataattcgctaatgcttgtcctagcgttgaccgcaattgaggtcgttcaacaactgcatccaccatgccatttttaaacagctgatccgccgtttgaaaatccgccggcagcttgacaggcaaagtttgttggatgacccgggctccggcaaagccaatcttagcacccgcttctgcgataatcaggtcacccttaaacgcaaaactcgccgatacgccccccatagtgggatctgtcagcactgtgatcaagggtaacggcgttgctgctaaccgtgctaattctgccagaatcaaattcattccgaccaaggcataaacaccttcttgcatccgagcaccacctgaggcggtcacaatgatcagtggtagccgttgggcccgcgcctgttcactagcgtgcaataagcgacgtgtgaccgccgtgtttaacgtccccatcataaaatgactatccatcactgctaagatacagggttgttgctcaatcagggccgttccacagacaacagcctcgtttaacccggtctggcgttgagcccgccgcagtttgttcgtatagtccgggaaccccagctgattgacaggccgctcagtcatcgtcaacggctgaaacgccccttcatcgacgagttgttctaatcgttgcgccgtcgtcaatcgttgccaatagtgacaataaggacattgctgataagtgccccattggcgttggtggacgtgccgaccgcacttagggcaggcttgccaggtcccagaagctggataatgactcatttcgacgcctcccaacgtgctagactgtgaatcgtgtactgatcatgaatgtaggcgggccgggccaccgtttgctgtagaaaagttaagttcgtcgtgggtcccgtcaatgttacttgcgctaaggcccgttgtaagttgcgcacggcttgctgacggttcgcaccggtgaccatcaacttggcaattaaaccatcatacatggttactagccgatcgccctgatgataatccgtatccactcgtacatcggctggccagctcagcgtttcaatccgcgtctgcttaaccggtaaggtagcggtcaatcgagcttcgatcgccgtacacttgggctgcaagccaacatgttctggaaaatcaaccgtgacgccagccgcctgtttgatttgttcagccacaatatcaattccggtggttaattctgtcaccccgtgttcaacctgtaaacgcgtattcatttccatgaaatagaactgaccatccgcaaataagtattcaattgtgcccaagctttgataatgtgtacccgctaataactgccgggacagatcgtataaggtccggcgttgtgtctcagtcaaaatacttgccggactttcttcgagaaccttttgcttgtgcaattggaggctacagtcacgatcaccaagaatgaataatttcgtccccgtaccgaggacttgaacttcaatgtggcgggcagttgtcagaaattgctctaaatacatcgcatcgttcaaaaaggacgcagcagcttcttgacgcgcagcccgcaattgttgatggagttcatgaacgtcggtaagcactcgaatacccttgccaccgccaccataactggctttcaaaactagtggaaaaccgatcttggcggccgcgtgtttaatatccggccatgctaagccctgtaatgattgacctgctagtaccggaacggcttgttgccgtgcaaaatccttagcgcgggccttatcacccatcaacttaatttgctcagtctgcgggccaatccaggcaatgccacattccgcacacatggcggcaaaatccgcattttcagctaaaaaaccatatcccgggtgaatcgcatcggcgtgcgtattaattgcagccattagaatcgcttcggcatttaaatacgatccactggcagctgcaggtccgatacagaccacttcatccgctaattgtgtgtaacccgcatgccgatcagcagttgagcaaacggcgaccgtctgaatattcaattgttgacaggctttgataatccgtacggcaatttcaccgcgattcgcgattaacagcttgcgaaacatagctaccgatcctttcgcattgtaaataacggttgttcgtactcaacagtggcgtcgtcagcaactagtactgctgttaacgtcccatcggtcggactaactaatggattgaataatttcatactctcaatctggcctagttcttgaccagctgtcagtgactgaccaacctttaaatctggtgccaagtggaccaccccgaccatcggactcggcagtgtaacgacttcatcttcagtctccgcaactgtgctggcaggcgtagcggctacgggagttaccgtttctgaagctaacgctggttttgtcacttcaatctccaagtcgccggctttaacgcgaatttgctgataaccctgtcgcgcgtatttctcaactaatcgatctaaatcttttaattccatctgcacacccctacttcttgatcaagactgagccatacgctagcccgccaccaaatgctgttaacaacactggcccagttaaggtatcaaaaacattggctaaggccattgccaccccagctgaggacgtattaccataatgatcaacattatgtggaaacttcgtcattggtaacgccaagttagccgcaattttttcaatgatccgtaaattagcttgatgacagatcacgtattgtaaatcactgggtgtcagttgcgcactcgcaattaacccacgcatctgttctggaacaaccgtcgtggcaaattgaaaaacatcccgtccaacttggtaaaacgcatccgtttgcgggtagttcgttgcggcaacttcagtaatcggccgtactcgtccagagtgaatgaccgtagcgtttccttgcgattctaatttctcagagatcaagctatttccatctggattgtcagtagcttgtaataacgcgccaccagcaccatccccaaagaagacggctgccgtccggtcttgaaagtccatcatcttggaattaacttccgcactgatcaccatcacattctggtattgcccactgcgaataaacttgtcagccgtcgccaggccaaacgtgaacccagcacacgctgcactcaggtcgaacgcaaacgcattatcagcgccaatattagcttgcactaaacaagccgtcgcaggtgttaaggcatcgggcgtaattgtcgtaactaggatcaaatcaatggcactggcagctaaaccacttttttgtagtaactgctgggcgacctgggtggctaaatccgaggtgttttcatcattcatcgcgtagtgtcgggttttaatcccagtatgcgcctgaatccattcgtcgctagtgtccataatggctgctaattcgtcattatcaacaacgcgtcccggaacatattgtcccatggcggttaattttgtataagttggcatttttaaacccccgctactttccgtttcgattagtttaattttatcaataaaagcctatccgtcaaagtttacggctgtatttttggtaaatctttagaaacctagccaaaatgaaagaacagtggtgcccataaccgacacaccactgtccatcataactttgttaatacttatctggcgccataaagccatttttagctaatagcggcatcacatcaacccgtttatccgtcgggactttctgcgcaaacacctttaatcccgctgcttgtaacgcatataatgcccgtgcttcggcttgaccgattgcaatagcattggtgaccatcaccatgcccgctgaaaaagctagactaccaatatcaatgcccgttttgctaaaatcaagtccccccgctactaagcgcgccatgttctggggcgtatcagttaggattagtggctttacttcatcaaatagcgagtcttgataaatctcgatcattttgtcaactgtaatcacattagctttcacaccagggggcgcggcttgcacaattagaatcttgcgaagtgcatcctgggcaacttcgtctgagacgaccaaaatacggttaggactgaccgtcttggtccacaccgtggcaacttgcccgtggagtagccgactatcaatgcgtgctaaacgaatatccatcgtcatagcggctcatcttccccatcgtcctgtaacaacttgagatgcttaatcccaatctttccagtctcttcaaggtgggcaatcacctcatcaattggcttatcacgaacagtgtaagcctcaatcagcattggcaggttcagaccggtaatcagacccatgcgctctgtatgttcggcaacgatccgactagcggcgttaaatggcgaaccgccccataggtcaaccaagaataagacttggtcatccgcgtcaaaccgggcaaccgcagcagctaatttatcagctaattcattagattcttcgtccagttgaaaggtaaccgtttggaccttatcttgcttgccaaagatcatgtaggatgaatcgacaacgccctgcgcaaaactcccatgactgacaacgacaaatgctaacatctactttccctcctcagtcggttaaatctactcaataagatacatgcaaaaagcatgccaagttagtgtatcaactcatcgcgacctttgcctgatgagtctccaataattgcacaatataataattttcagcatctgagaaggttaactgtagttgatctgtcaattgctgattggcctgttgcacaagtgggtaccacttcgatgccataatgtctggcatctcttcggtgggtgccgaaatttcatctttgatggccgttcgttctagcgcacccgctaagtgcataatcaaatcaatgcgaaaagcattcgtcattacaccatccaagtgcgtcgcaatcacttcgctatactcccataaaattcccgttaacttcttaggatttaaaaacgtgaagtaatcgcctaagtaccgttcgcagagttccggtgtcaactgctgactttcttccgccatggtctgtggcgaatcgatacccgtcgctaactggtcaataaacttttcgccaccaccttgtagcaattcttccaatgaaataaaagggacgtctaattcgggttttgtaatcccagttgccgcaatgatttgataattttgactgatttgttgtatccgtgtcttcatttcgaccactgagattgggaataccgtaataccttcgataaagttttgagctaataaactgtctaaaattgacttgatacgttcagccgtcccaacgccggtcgcacaaattgcaataatcgcccgttgtgccgtcttatccgtcgctaaggcgggcttgactgttgcgcgctgactatccgttggtaggttccgtgaaattcgcgaataacctttgaaaccaacgagctcctgatacatagaatccagatcactatcgaccaggctagccttccgaacggcttccaaaacaaccggcgtggtcaccatgtcaatcgttcgcgtcgcaattcctgtctcctgctgaattcgttccccgaaggtcgttaacgaccccatatcgactagtaacaaaattcctttcccagaatcaagcttttctactcgtcgcttgacgtgatcataggcgacactcgggtccatatcgagaggcatgtcgaaagcctgaacatcataatcatctaacaattgtccgactacctgtgccatggaagacgcggtactcatcccgtgcgctgccaccaacacgccaactttgccgttaagctgcatcgattttaacgagatgagcaaaatggccagataataaacttcggacttgggaatcggtaaatgataccgttcctctaatccttgcttgagcgcctccgctgctttgatttcagccggatattcacgcaccatcgctaacatatccgaactcatttgacgcatgggcttgcctgcctggatgcgtttgataaaggaactgacgtgcaagctcacagcgtaaataaagttatccttgaagttataacccagcatatcttgaaccgtcatctgtgccgtcttggtaaaatcaataacgtcctgatcaacgatctcggctaacttgttttctggtgaaacttctaactgattttgtttataaaatgatttcaaatgcacattgatatcggtcgtgatgaaacgattgatgtgttctttatcaaggccttctcgtcggagtaacgctgctttatcaccaataatctcatataaattatatggtaattcataattatcgttcttattacgaagcggtgttggaccatcatttggcttcacgatgagaaccgggtccaacaactcagagatggcccccagttcgtgacggttagaggctactgtcatgagaccgctacggatattctgtggcaaatcatccatcgtgattgtgatttcactgtcattttcgatgctattgacaaaaccctgggcacacaccagctgaatgttcgacttcaactgaccgacgttcccaaatgtgactgagccaagtaaggcctgcaccacgtcctccgttaaccgaatctgtttattgattcgattagcttccaatgacaataatgccttcagtaattctaaacgttccttggctgagcgatgattgaacgctggtagctgaatcgtaatcggaattcgccgaacaaaggtctgcagtagggtactttctgggtcctcggtcgttgcacagactaagcggacattggcatggtgactcttcgccgtctcaccgagtcgtgaataagtcccgtgatccatgaaataaaaaatcatttcctgaccttctggtggtagacggtgcacttcatctaggaacaacatgcccccatccgcttcttggatcaaaccgtccttatcttcattagcacctgtaaaagaccccttaacataaccaaacaaatgcgacatcaataattccggattatgcgcataatcggcacaattgaatgtaatcaggccttgcgggttcgttaagacttgttgggtttccgcaaaacgatacatggcgtttgcaaagtaagttttaccagaaccagtcgggccaatgattaatgtattcaatccccgcggtgggtaaagaatggccgctttcgcctgttccacttgattagcaaggctctcatgcgaaccaatcatgctggcaaatatatcatttacaaccggtttaggcacagacgtcgcgacgggcgctgtcggtattcgctctgtcgtcgccccattcgctacgccactagttgttgtggccgttgtggctgtcgcattcaccggaacatagtgcacaggccgccctgtcagcttgtgcaactggccttctcgcaccagtgcatttaattccttgctgacgtttgaacgcgctatcattaaagcggtcgctaccatttccgtcgtcagtccgtatcgatcgctatgttgacggacgtattcacaaatcttggattttctggtcaacttcgccactcctttttcaccactatcaaatagctgatccgttttgatacactataacacactatattctaccatagttcccgactcagttactttttaagacttgtcagtacaactatttctgtttcatggcattgaaattccatttatgacgcaccttaacgtgctcagatactgcttttgatgcgtcaaaaaaagcttagacactgcaacgcgctaaccccacccgttgatacctaagcttcttaaactaactattaaataatcaccaatccgtcggcaaagaaccctcgacagcattggtcattatttcaaatacttatcttttttacctttacccttgaatattctcccaaggacttggaaaaatgtcagtgattttacaattcgatcaggctcaatatattgccgaacggctcgtaacactttcttagggtccttagctgagaaagtaatcataccgttccgtttcgtttgaaaagagaaccgtggaatccaacggccaccaaacattacggatacgaccacatatttcacttcagtccaagggatttgaataaaattacgaacattgcgatcatcataaaattcaaagccgttatcaccgaccataattttaccgtaatcggtcaatcccatatgtgaattaccgttcgtaactaaatcaaccttagtattgattgattgcaccatattaatccctcctcgtatccatcctcataccgattatacggcgagtttgtcagttatgcaaagtacgcttgtaaataaaaaggatgagctcccacgagtccatcctttaaatatgacataagcaagtattacatccaaccaataacgtgcattagaaccccaaatacgaagaggccaagaatgataatgattggtgaaactttcttctttaataaccacatgcagaggaaggttaacagcaacgccatcaaaccaggaatcaattgattcaagttatcttgtaaggtggttaccttgtatttgtcaagtgaacggccagcagcttgttgtgttaaagcttccttaacaccagaagcaccctttggcagtttatcccagtcaatgtacgaaccagcttgttgcttaatggtcgaaactttaactggactgaagtcaacaacaacccaccgttcgattaacgccgccaagataaacatccctagcatggaagcaccacgggtaatatcttgtaaaataccaccagataagtcatcagtaatcttagaaccggctttgtaaccgaattcttgggtataccacatgaagcccatacgaattgcattccaaacaacgaagtacaaaattggtccaacaatgctaccagaaatagccaatgatgcagctaaggcaccaacgataggcttaaccgtgtaccagaacactgggtccccaacaccggctaaaggtcccatcataccaactttaaccccttgaatcgtaacgtcatcaataggtgccccattggcacgttcttcttcaagcgctaaggtaacaccaataactggtgaagccacgtatggatgggtattgaagaattccatgtgacgcttcaaagcagcagcacggtcttctttagttgtatataatttcttgattgctggaattaaagaataagcccaaccaccgttttgcatacgttcgtagttccatgaaccttggaggaacgttgaacgccaccaaacatgcagacgatcacttttacttaatgtaacttttttagtaatatttgtagtttcagacatctcagtttgcctccttctctaatacttgtcgataatgtcgccaaccggatcacccgtgttggagccaccaccattgccagagttaccttgctttgaaagtgccaagtacattaaggctaaggaaataccaattgcacctaaaccaatcaaagtaatttcactgatcgcagctaaaacaaaacctaaagcaaagaatggccaaacttcacgagaagccatcatgttgataaccattgcataaccaacggcaacaaccataccaccaccgattgataaaccatcagttaaccagctaggcatagcgtttaacattgccttcactggcgtagcaccaacggccaaaatcaaagcggctggaatcgcaatacgaagtccttgcatgcagatcgcaacccattgccagaagtcaattttactaaaactaccttcttcagcggcacggtccatgatgtggacaatcccagttgctaacgtacgagcgatgatcgttaagagtaacccagcaacggctaaaggaacggcaatcgcaatagctgaagtaactccggcacggccttgaccacctaaaactaaaataattgcagatgcaattgatgctaacgcagcatcaggtgcaacggcggcaccaatgttggcccaacctaaggcaatcatttgtaaactcccacctaagataatacatgggactaattgtccggttactaatccgattagggtacatgcaacaactggttgatggaagtggaattcatccaaaataccttccataccagctaaaaatgatacaagtacgactaaaatcacttgaattacgttcaaattcatgatttaatcctccatcttttctgatattcttggaactacttttgttccttcaacatattttcagctttgttcaaaatgttatccatattttctttaccatcacttggaaccttccgaacatcaaattcgatgccgtctttttcaagtttacggtaagtgtcgatatcatcttgatcaaatgccaaaaccttgtttggttgaactttaccagccgaatgagccatcgaaccaatattcaatgtcttaattggcacaccaccctcgattgcacgtaatgcatcttgtggtgtttcgaataagaccaacgccttttgaccaccaaagtgcttgtcatctttagcaatcttaatcatttgagcaattggaataacgtgcgctttgacaccagatggcgctgcttgcttgatcatgttagtccgcagttcgtctttagcaacgttatcagacgcaacaatgatccgagttgggttaactgtcttactccaagcagtagcaacttgtccatgcaagagtcgcgagtcaatccgtgctaacccatattccaacttccctggccggccagcgttattgttggtcgttgcagcggcagcagccttttcttccttaggtgctaatgcttcaggacgaacctttacgccatccttagcagtttcaatgatatgcgtggcaatttcgtgtgccgaatccattgaaagtcgtgaagcatacgcttcaattaacattggcaagttcaaaccggcaacgattgcccatttgtccttgtgtgcttcaaacaagccgttaacttgattgaatggtgtaccgccccaaaggtcgactaagaataagacttgctcttgatcgtcgaatgaagcaatggctttttccaacttagccttgatgtcgtcagggccttcgctaggcatcaacgtaacggcttgaacgttttcttgttcgccgaaaatcattgatccagattgatagatgcctttagcgaattcgccgtgactagcaatgataatgcttaccatctttgtacctcctattttttcgttacagtcatataaaacgaataaataatatctaaattgcctgtaactatttatgtttttgatactgtaagcgcaatctttttcgcactcacttatatatatgcaaattccgtgccaaaatacactaaagctaaaagcccttatttcaggctagaagttgatacactagtgcgatacagtattaaaaacgattattttgtgtgtcaaatagcgtatttttaatataaaattatgaaacagtaactaatgttaactatggtatcaatttcttaatagctcagtgcccgacgaccatttaattgccacatcgtctcaaacgcttggttatccatctgtccggattgaccacgccaaggatcattgtacctaatagttgccgctgtatatccagtgagcgtcactgtatgactcgcaaaaccatcgagtccctgaacccaagcgactaccggatgacgtttagcgagctgcactttaattcgttgcaggcccaccccactgagatctacagcggacggcagatagtggcggatcgttggtaacaagccttgggggtagatgtagagaccaataccataggccgaagcaggatcgccaacaaagccagtgttaggattcgaactgcgcggcacgtggctggcaaactgttccttattaatattaacgccggcatactgcagcatcatggtagtcgctgtcatctcacaccccgttggcaactccggtagctggtcaatcagtggtacccgcagttgaaccgacgccgtactggcgggttttagctgattagcagctatccagccgctctgctgatgaccattatgcacatagtagaagcgttggtaatgcccgttgcgataaatatcagcttgctcagtacgcgtccactgtgtatgctggtgatactttaaatgtaaattaacacgcaattgggcacgctgatgacgcacgacggttaaatggtaaccgacaccgttctgactattcgtctgatagacccgcggctgcaccacctgaatccctgtaatcggataagtcgttacggccgcttgtgcggggtaaaccacgccactaaccagcaagccgcccaccaagatacgccaccaccatctactcattctaatcaatgcctggtcctcgccttctcttaatatcgtaatcagtagattaaccgttttcattataatgctggtaatcatgagattaaacaataaggtacggcaaatttggtgaacatagttgaagtagttggcaaaaaagcaagcctggaataacgtgaccagtccaatttaccgcaacaaaaaaagaatcgatccttcaaggcttaacctatcgaaatcgattcttatattcgttagtgcggccaagaagattcgaacttccaccgggttaaccccgacaagatccttaatcttgcgcgtctgccaattccgccatggccgcatcacaactcacaaaaaatatcataacaaaattttgcgagtctgacaagcttattttaagatttttgtacttttacaccagttgcatccattggcaataagaataattggccggtgagtgttgtatcttggctcaattgtgcctgcaacgtagcgagttgaccgtaatcacccaaagtaatcaccgtcggcccagcaccactcaaataagtccccgttaatcccagagcatgggcatggtctctaaccgtttgtagtgccggcactaacttagcccgatactgttcatggaactggtcctgttctagcagcggtaacgccacgtcccaattttgagttgctagagcagccactaacgtatttgccacactactaccagtaacggcttggtggtacgccaattcagttggcaaggcttggcgactggcggtcgtcaatagcggttcgttaggcacgtagacacttgcaaaaagcatcggtaacggtaacttcaccgcacggacgcgtccatcagtgttcgtcgccacaaccaagcctcctaatagggctggtgcaacgttatctggatgaccctccagttgagtggcaacttccagtagctcagcagaagagcgcgttgcgccggtcaattcgtttgccagcactaagccggctacgatggccgtcgagctactacccaatccgcgcgctaacgggatttttgaagccatctgtaaatgctgtggttgtaaatctggtaccaaatgcaacgccgttttaataattaagttgcgttcatccgtcggcacatccgccccaaagggatggtcaatctgccaatggtcactaggttgcaacacttgtagcgttagttgcatgtccagcgccagaccgattgaatcaaaaccgggaccaagattagcggaagtcgccggaaccgaaatcgttaacatgtcctcacctacgcattctttaaaactttataactcgctaatagttgcatattctcttgttcaccgatttcacgagtgatatctgctaactgttgatcattcatggcatgggtaatgatcacaacacgagcgttgccgtcacctaattgattttgaatgattcgactaaatgaaacttctgcgcgggtcataatcgccgtcaatttcatcatcatccccggcacatcacgcatcttcaaggcaataaagtgaggatacacaacatcttcaggcgttgctaagactgtctcctggcgataagagttaaacgtgttaccagtcgtattcaacgcaatatttttcgcaaccgttgtaatatcactcagcacactgttggcggtcgggagttctccagcgccgggaccgtaaaacatcgtgttccccacagccgttcccgttaccattacagcattattctcattttgtaccgtggcaagtggatgttgatcagaaacgagcacaggcccgactgataccgcaatgcgatcgtcaatttcttccgcaatcccgagtaatttaatcgtatacccaagctgatgagcttccgcaatatcctctgggctgattttcgtaattccctgaacttgaacgtggtcgagggaaagactcatcccaaaggcaaactgcgttaaaataatcatcttgaacgccgcatcaaggccttcgacatcattagtgggatcactttcggcaaaccccaagtcttgtgctgagctcaaggcttgatcatacgaccaatgcttagtcagcatctgcgtcatgatgtaattagtggtcccgttgacgattcccatgacccgttgaatccggtcagcggcgaaactattatcaatcgtccgtaaaattggaatcccaccagcaacactagcttcatagaataagtcgcgatgattttcacgagcaatctgaaccaactcccggccatattgcgcaatcaagtccttattggccgtcaccacgtgtttgccagcttgcaaggcttgcgtaatatattccttcgccggatgaattgaacccatcacttcgaccataatttgaatggacggatcatcaagcagggtcgcgatttggtcggtcatctgaacgtcccccaaatcaacttgttcgtgctttttcaagttgtggacaactacgcaggctagttccaacttacgaccggtaatttctgaaatcttttcctgatgcgcttgaagcatttttacaacgccggtcccgactgtgcctagtccgaccacaccaattttaatcgtttccatcttaatccctccatatcaatagttaagctaattctatcggaagcgtaccactttagcaaaccttttcagactaatttaattggcccctgacaacgaccacacgtatagcggcgagtgtccatgcggcgcttgcggtaataccgccggccacaccgttggcattcataaatataccgatacggccgggccgtcgcctgcttcggcgctggtgcatagcgcgagccacccacttgcgcgagtaatcgtttaaagtctgcatcacgatgccgatatccccgcttagtcaaatgtaaatgataatggcacaattcatgcttgatgacgccaatcaaggtggcctcatcaaaatcagtcagcatcttcggattgatatcaatatcatgcgaggccaactgataacgaccacccgtcgttcgtaaccgagcattaaaataagcgcggtgctggaacggacggtgaaaatcatgcatggaaatggtcgcaacgagctgctgtaactctaaatcagtcattatgcttcagccggtgcaatcatcgtcaaagcgatgcgctgccgctgttcatcaacttcttcgacccacaccgttacgatgtcgccaactgccaccgcctgacgcggatctttcaagaacttatccgttagtttggagacatgtacgaggccatcttgcttgacaccaatatccacaaacgccccaaagtcgaccacgttgcgtacggttccttgcaactgcatccctggttttagatcactcatctttaaaacgtcttgccggagtaacggtgcaggcatcgtatcacgaacatcacgcccgggcttttgcaaactactaataatatcctttaaggtcagttcaccgacaccggtgctggtcgcaagttgcgctaaatctaattgattcaactgttgggctttagtcgtcccaacgtccgtcgtcttcaatccagccgctgccaataacgctttggctgcgggataactttctggatgaatatccgtgttatcaaaaacattcttgccgtcaatgattcgcaggaagccgaccgcttgttcataagctttcggtcccaaccgcggcacttttttcaattgtggtcggctcgtgaattcgccattttcatcccgataagtaatcacattttgggcaatcgtgctggatagccccgaaatatgcgtcaatagctccgaactagcggtattcaaattgaccccaacttggttaaccgcggtctcaatcaccgtatctagctgcgttgtcaattccttctggggcacatcgtgttggtattgccccactcccactgacttcggatcgattttgatcaattctgccagtgggtcttgtagtcgccggccgatactgatcgcactacgttgttcaacgtgtagctcaggaaattcagcacgcgccttagcactagcagagtacacggaagccccggcttcgttaacgatgacataataaaccggtcgggtcatagtcttcaatacctgtgccacaaactcctcggattcgcgggaagccgtcccgttaccaatcgcaatcatttcaacatgatacttctctaaaaaggctttaaactcacccgcagcagcttcccgtttggcagttggggctggtttgtgtggataaatcacaagcttatctaagaacttaccattcgcatccatcacggctaatttacaccccgtccggtaagcggggtcgaaccctaataccacgcgaccttttaatggtgcctgcattaataagtggtacaaattatcgccaaagactttgatggcctgttcattggcagccgcactcaattcgttgcgaagttcacgttcgatggccgggccaataaagcgtttgtaggcatcctgataagcagcttctactagttcaatcgctgggccgtggtgctgaccaataaaacgaaaatgacaataccggtcaattccagcacgatcaacatcaatgctgactttcaatactttttcggcttccccacggttgatagccagtacccggtacggtaccatctgcttgatgggactattaaaatcataatactgttggtaaacaccttgttcatcggctgctttacccttgggtttcacttttgcgactagtaagccccggtcacgcgtataattccggacccagtttcgtaaaccggcattatcaccaaaggcctcagccaagatttcgtgagctccagctaacgcggtattcgcgtctgtgatgtcctgcgcttcgttcacaaactgcgccgcgtgttcctgaataccacttgccggaaaacgtaataaccaagctgctaacggctccagtccagcatctttcgcaatcgttgccttcgtacgtcgcttctgtttgtacggtaagtacaaatcttcgacatcttgcaacttgtcagctttttcaatggcttgctttaaagccggcgtcaagtgatcttgttcagcgatcaacttcatcacatctgccttacgactctctagactcgcaagccgatcatagttatctttaatttcgcgaatttcaacttcatctaagttaccggtacgttcctttcgataccgtgcgataaacggaacggtgttgccttcgtccatgagtccgagaaccgctttgatctgttgcggtttaaacttcgtcagcgtttgattaactaacgttaaaatctgattatccattatttcacccaatcttttaatctcattacattatattatacgcgttttacccaagtttccgcgccgaatgaccatctgaaaattgtcgttgactgtcactaccaatcgaagccattaccgatactgttcacacattggttgtgagctggaaaaaaacagcccattaggctaaacgagcacggcgcggccgcacagttggctgccccgcaaccaacaataaaacgctcggcaacgcataaacgttaccgagcgttttattagtgtgctaaatccaatcacccagattagcgctcctacatgactgtattcatgatccgttgcacgttatttgaaacgcggcccatttcagtctcttgatccgtttcagcctgattaaaagcagccacatcaatcgtttgatcgtcgatgttcatgctagccgtcatggccgcacacgcattcgtgtaggcttcgtatgctgctaacaaattacggtgccgccccattaaccgtgcgggtaccgcaacttttttcaactgtgccaaattttgttgatactgttcagtaccatcgctaaattccatctgaatatcattgaattcagctggaaccattttggcaactgcgtcattatcaatggcctgacgtagtttttcaaaagatgggtttaattcttcccccattttttcagtactttcgataactttagacagtactggcatatacgtttgaatcgttgcttttttcatgtacaaactcttttctttaaattagttagccttattttacccctaatggatgggttatgcgcgccgcatgtgtcgacgttggaagaacttaacaatttcaacaatcacgaccatcgataaggaagctaaggccacgattccccattggtaagcatccaagtgactcacgtggaataacccattcagaccgggaacgacgattgtcatcgccagcatcacaaatgcaattagaatcgcccaattaaagaacttgtttcggaacaagccgaccgtaaacaacgattcatgaatggatttagaattaaacgcgtggaacaactgaatcaagccaagggtcgcgaaagccatcgttaacgcatcagcatgagctaatgaggccgttgcgtgaaccggatacgtcaaagctaaccagtacacgagcaacgtaatgccaccttccagtagcccttgataaataatactgctgaagaccccacctgagaagaaattagaatttctcccgcgcggtttatgctgcataatgttcttttcagttggttcaacgcctaaggcaattgctggcaaggtatcggtcactaaattaatccataagatatgcactggtgccaagatttgccagcccaacatcgtcatcacgaacaaggttaagacttcccctaagttcgctgacaaaaggtactgaatcgccttttgaatattggcgaacacttttcggccttcctcgacagcaaccacgatcgtggcgaagttatcatcagccaagaccatgtcactagcccccttggaaacttccgtcccagtgattcccataccaataccgatatcagcagccttcaaggcgggcgcatcgttgaccccatcaccagtcatagcaacaactttgcctcgtttttgccatgcgttcacgattcgaactttgtgttcaggcgccacccgggcatacaccgagtaatcgccgacctttttgccgaattccgcatcactcattgcatctaactcggcaccagtaatcacagcgtcatcttcgccagcgttaatgataccaagacggacggcaattgcttcggcggtatcacggtggtcacccgtgatcatcaacggccgaattccagctgatttagcttctgcaacggcttgttcaacttctggccgttctggatcaatcatgccgaccatcccggcaaagaccaggtcattttctaacgtctccgtattaacagtcgttggaaccgtggtgatcactttataagcaaatgctaagacccgtaaggcttgcgttgccaattcatgattaacagttagaatctggtcacggcttgtcttggttaacggctgaacgtcaccgttactttcaatctgagtgacccgtttaagtaattcatcaggagcccccttgacggctactaagaagcgaccatcttctaaggggtgcaccgtcgacatcaatttacgttccgaatcaaaggggacttctgtcactcggggacggtccgtcaacaactgatcgactggataaccctgatccaaattatattgaatcaacgctgtttccgttgggtcacctgctaacccatccggcatgatcttcgtatcattacttaaaatcatcacttgcgctaaatggctatcaagcggcaattcagtagcgcgcgcgtccaccagttcctggttgacgaccaatttttcaacggtcattttgttttgcgtcaacgttccggtcttatcagaggcaataatatcggtacttcccaacgtttcaactgcgggtaattttcgtactaacgcatgccgtttggccatccgctgggttcctaacgctaacgtgatcgtaacgattgccggcaacccttctggaattgcggctacggctaacgaaatcgccgtcaataacatgttgatcaaactctcttgaccgcgcaacattccgataccaaataccactgcggcaataactaagattaaaatcgtcagcgacttacctaactgtgtcaagttcgcttgcagtggtgtggtcgtctcatcggccgcttcaatcatgccggcaattcgacctacttcagtctgcatcccagtcgccaccacaatcccagtggcccgaccatacgtcacgttactattcatgtacgccatgtttaaccggtccccgattggtaattccccatcggcaatcatctccgcctgcttctcaactgggacagattcacccgtcagcgccgattcttcaaccttcaatgacgcactctcaattaatcgtaaatccgcgggaacgatatccccggcttctagcgacacaacatccccaggaaccaacgcgtcactcttgaccgtttgcagctgaccatcccgtaaaacagtcgcgtccggcgctgacatttccttcaacgcgttgatggcctcttccgctttcgattcctggaagacaccgaaaatcgcatttaataccaccaccaataagatgataacggcatcgacggcttccccagtaaaggcggcaatcaaggcggccactaacaggacgataatcatgaaatccttgaactgcgcaataaatttttgcaacaaggaagtcgctttttgctgattcaacgcattcggcccatattgttctaaccgttgcgtcgcagcactttgctgtaagccgtgttcatcagtgcctagttcctcataaacggcggataacgcttgttgatactttggttttgtactcatcgtaagctccttttctggcatccgagccccactccctaactgatttccagatagaaaatgagactcatgtatgcacgcaaaattgtgtgaacatacataagtctcactatttaagacaataccggattggcttcttgctgacgatattgccgcagaatatttctgctagttactcccttatgattgtatcgtaagaataccagattccatgggagctgtctagcaaaataatcgctttgactacctctgcattcgccacagcacttggatattctcacattaagcgtttacatattttaaaccattctaccgcttttccaccaatcccaccaatattacggtagtcaccataaaattatgtgactatgcaaaaaggcgacctgaagctgaataatcttcaagtcgcctttttaattaggttagccgtaatcctgatcgattatcagctaactagcttatttccaaaaatcatcaaacacagtgatggccgcgtggcgtttgtgggcagtctttaagtaccacgcctcaatcttttcggccgcagcatcgctgaccgtccggccttccaagtaatcgtcgatgtcgtcgtaacgaacacctaacgcgacttcatcaggtaatgctggccgatcttcttccaagtcagcggtcgggactttgtcatacaaatgcttgggcgcatctaaagcggccagcatttgtttaccttgacgcttgttcaatcgccatagtggcacaatatccgcaccaccgtcaccgtacttggtataaaaaccagtaacagcttcggctgcatggtcggttcccacgacagcaccgtgcatttcaccggcaatcccatattgcacgatcatgcgttggcgcgctttaatattgcccttgttgaaatcatgaatcgtcaattggttagcttccaatgcagttaccatggcatccgtagccggttgaatatccacccgatccgtcacgtcggcttgcataaaatcaatcgctgccatcgcatccgcttcatccgcttgattgccatatggtaaccggactgcgatgaattgatagcgatcatcacccgtttcctgccgcatttcggtaatggccatctccgtcaattttccagctaacgtggaatcttgaccgccagagatgccaagcacataggtcttcaaaaaggtatttttagttaaataagccttcaaaaaatcaatacttcgacgaatctcaacttctggatcaatcgttggtgcaacgtgtaacgctttaataatctcagcttgtaatggccgcattagtaagcttcctcctcatctttatggttaacgtggtctctgaccgtgttaataatattcattttatgatcataaagtttttgtgacaagtcgaccgggtaatcctgagggtttaaatcccgtttgtattcgtcccaaagtgcatctagactttcaaatgaatactccttgatttcatctaacgttggtaaagtataaacttgttgaccgcggtcatagatgggaaccaatagtggtcgcgcatcaaagtcactgaccgtcttattaatatacgtatagcttggatggaacatgtaaattgattcttcgttgcgcggatcttcatcgtacaacgtcacatagtcaccttccgacttgccatccgcacgcttcgtaatccgccaaacttgtttttgaccaggcgttgagaccttttccgcgttatttgaaagtttgatcgtatcaaccatctgatgatgatcattctcgatcgaaaccatcttgtatacggcccctaacgcgggttggtcaaaggccgtgattagcttcgtcccaacaccccagacactaatttttgcaccttgcatcttcaagttttggatcgttttttcgtccaaatcatttgacgcataaatcttggcatccggaaaaccagcttcgtctagctgttcacgcacgcgttttgataagtaagccatatcgccactatcgatacgaaccccttggaaattgattttatcacccatttccttagccactcgaatcgcactcggcaccccgctacgtaacgtatcatacgtatccactagaaagacacagtcatgatgggtctccgcataggccttgaaagcttgataatcgtttcgataagtctgcacgagcgcatgcgcatgggtcccgctaatcggaataccaaaaattttgccagcccgcacgttactcgtcgcgtcaaagccaccaatataagccgcccgggttccccagatggccgcatcaaactcctgcgcccgccgagtaccgaattctagtaagccatcttcaccgacaaccgatttaatgcgcgccgctttagtcgcaatcagcgtttgataattgataatattgagtagtgccgtttcaattaactgacaagtggccagtggtccttcgacttgtaacaacggttcattattaaagaccaagtccccttcacgaaccgcacgaatcgtcgcatcaaatttgaaattcgctaaataatctagaaaaccgtctgagtagccacccagttcacgtaaatacgcgatgtcagttgccgtaaaatgtaaatgattgatataattaacaactcgttccagacccgcaaataccgcgtacccattttggaacggcatcttacgaaagaacacttcaaacaccgcatgtttgttgtgaataccttgttcccagtaggtttggatcatattaatttgataagcatccgtatgcaaggtaaaactatcatccggatagatttgcgtcatgagtataattctccatttcgtaggtaataaccgtgtttacagtaagttaagcttattttagcattttttataaaagaatgcgcttaagcatccaaaaagttgcagaattccttgatttacctatactttaattatgattagaaagtgaggtcgcttatgtcagtcccttttgacacggttaacatcttaaacgtgccgtttatcaagacaactaacgctggttttgttcagcaacttcaaaccgatattctcgcgcatcacaatcgctttgtggtgaccgctaaccccgagatcttaatgtacgctcgtgaacaccccgattaccaacaggtgttaacacaagcggactatatcacgccagacggcattggcgtcattcagggggcccagattcttggcacaccactccccgaacggatcaccggctatgacacccttttaacactactagaatggggtagccaacagcaccaacggatctttttgttaggtgccaagccggccgtgttaaagcaagtgaccacgatcgttcaacgagattatcccggcatcgttgtcgcgggtgcccgtgatggctattatgacgacgaacaaaccattgtcgaccaaatcgtggccgcgcaacccgatatggtcttcgtagccactggttttcctaagcaggaatttttcatcgccgaacaccgccaacgcctcgatgcgctctggatgggtgtcgggggtagcttcgacgtaattgcaggcgcggttaagcgggcgccgttattttggcaaaaacaccacgttgaatggctctaccgtctgattcaagaaccaagtcgtttcaagcggatgctcgtgttaccccgctacttgcggttagttaaaaaaatagcgcgccagcaagcccattaactggcaatcattaccagttataagccactgcgttacgatgacaattgcttttgtgcgtgtacccagtcttcagtcataaatccaaaaatagctcacctagaataacatcctaggtgagctatttttggtatcaccactctaatcaggtgcccagcacccgactgactggttatttttcaagataaaactcaaaccggttaccaacgtactgggtccgcacgtattcaaacggttcgccggtttgcaaatacgaaatctgccgtaaccgtagcaacgcatcgccacgccggactgacaagtattctgcgatacgctcagaagcagacatcgccgaaaccgtctgttgagccttaccaggcactaaacttgccttttcttccaacgtccgatacaacgaactcgtaatttcgtccttggtgaactgcttgacgagtcgttctggaactgttgcgacctcaaaacaaattggcacatcatcaccatagcgaattcgttccatccgtagaacttgttcgttggcgcctaacgccaacttttcgctctcagatagcgacgggctcgtcacgtgatatgaaatcgtcttacttgatgggaccttaccctgggccagcattagatcagtaaaactggtgacaccggacattttttcttggaccttctgattcgcgacaaacgtgccggcaccgactcgccgctctaatattccttcgtcaaccaatgtctggattgcttgtcgaagggtcatccgactaacatcgaactgtgtagccagctcccgttcagacggaatccggtcaccaacggcccaccgacctgcttcaatcgcctgcttaatttggttgtggatttgaatataaattggcgaactcatggtactcatcccttacttctaatttatttagctgcttttttaccgtagctatatgttgcgactaaatcttgattgccatctaagatgttgatatcagcatctttaccggcttccaatgttcctttcttagtcaacccaaattcacgtgcttggttgacagaagccatcttaaccgcttcagcaatgccgcaaccggtgaacttctgaatattcttgaaggcattaatgaatgtcaggacagaaccagccaagttaccttcttcaagacgtgcttgaccatccttaacaatcactttttgaccacctaattcactgataccgtcgggttcacccttggcacgcattgaatcagtcaccaattcgatccggtcaacgcccttttgttcgtaagcgagcttgatcatgtcaggcacgatatggaacccatcacagatcaattcacagtacatgttgttttcaagcatggcatgaccagtaacacctggttcacggtgcttgaattcacgttgcgcgttgtataaatgcgtcacgtgagttgctttacttgctaataattgttcacgagtcgcgttactgtggcccactgaaggcacaatgccattttccaagcagtacttttcaaattcacgcgaaccaggatcttccggcgcgtaagtaatcaacttaacccgaccacccgacaacctgttccagttgtctaataagtcaacgttaggattcttaatgtacttttcaggttgggcacccttaaacgtcgccgaaatgaatgggccttccaaatgaaccccttggataaccggattttcatcggcggccttgttaataccggccatcgaatgatctaagttttcgttggattgcgtcatggtcgtacagaagtatgacgtaataccttcgcgggcaaccatatcattaaccatttcgttaatttcagctggattcccgtccattgaatcaaaactataaccaccatggctatgaacatcaatgaagcccggtacaatcgttttgccactcacaaattcgatatcatcatcgggttgggccacgtagtcatccattggaccaaccgcttcaatttccttaccgaaacgaatgtagccgtcatcgatcttttctagaccagtataaatgatggcatgttttaacactttgctcatgaacaattcctccttggatttatctggtttaattataatcggtatagaccaaacttgcaaccaccagcaccaagtaatttaagattcgccaagttccttcgcaatcgtcgcatcaattcccttcaccactgcggtcataaagccggcctcttccatggccagtaatccagcaaccgtcgtgccaccaggtgaagaaacttgatcgatcaggtcaaacggaattttatcagaagctaaaacattctgcgcactgcccagcgtggcctgcgccgcaatcttagtcgctgcatccttgctcaaaccgtgcttgacgcctgcgcgggccatcgcgtcaataaagaaatagatgtaggccggcgaactacctgctaaggctgaaaaagttggaaaatctttctcagcgatggcactcgtggcaccaatcgcatcgaataattgttgcccagccgcatattgctctggtgttaaggcatcattaccaaccaacgccgtcatcccggcaccaatcgccacgttcacattcggcatgattctcagaacggggagatcagggacaaccgtggcataatcggccaaactcaatcctgataccattgtaataacccacttgcccgttaaagctgcttgaacttcttttaatgcggccaacgcaatgttcggcttaactgccaaaacgataacgtcagcagcttgtgccacggccaaattagtgtcacaggcctgtagcccatttttttgcgcataaggttgataactcgcagcatgggcactgtgaatataaatatctgctgggacgaccgcttgttgttttaaccacccatcaataatcgcgcggcccatgttaccggcaccaatgaatccgattttcatccgtaaaacgctcctctgacttataatttatatcattaaccactaaccgattaacggctaggcaggattaaacagacattcccgcttactcttctactataccaatatttgtgaaactgtgggtaattaatcacttctttcagctcaactttcactatcaacaaataaatatcacgagccactctattaaggtgattgcttatcaatactgaaaccaattgattaatctattaataatcggccttcaatatgtgcgaagctcgttgacaggtctgcttgaacaagctaatgtaaacagcaatcaaacacagcgttgcttccgaacacggctgtctaaaaacaactaaggagtgtttcactatgaaccagaacaaccatttccgactcaccttatcaaccctgctgcaacaatgccagcaagacatcactagtctgcccacggccatgcgcgccgtcttcagctggcaacggggacttaatgaattaaagacgcttcgccgcaccactaagttgatgatgagcacgatgctaatcgtaaccatcattggttttattctgggtcgcgattacagcctacatggctggattggcctattgaccgggattacggtcgtgattaacttaattctggttgatcaagggcgactgacgaactatagttggggcattattgcctgtgcggcttggcttactacggccatcaccaatcggctgattggtgacattgcgtcgcaatcattttaccttatcatgcaatttgtcggcatcaccgtctggcatcgtaaaatggcagcgcaacccgatgccagcgaactgactggtcgtaaattgagcaaattagccggttgtgcctggttcgcgttagccgtactcgtctacgccattgtcttacactttagtaaacaacttaacggtaaccaaatctacctggacgcgaccctgttaccacttgggattgtcggtagtgtcctcatggtcaacggttatcgttcccaatgggttgcgtggatcacactcgacgtgattaacgttattatctggttcaaccaattaaaaggcttcagtcctgcagccgcctcaatgttagcattgcaactagtgatgctcgctaacgcgttatatggtgcctacttgtggttcttcggtcaaaacactcagcaagataaactagatacacattaagcaagctaactggcaatcaaaaccaagcactaatcgcttcaaagttaaacacataactttgaagcgattttttatttgggttaccgttcgggtggctacatccttatctgaaaaatgtctatcagtttacatttagcgacgagtttgtttaagttagaactaattaactgactattgagggggacgtttaccatggtgacagtcgttcgtcgcacacttcacgataaaatctttattattgcattaatttgtgctggtttaagtttgttcatcgggacaccccaactgacggcaattaattgggctacgattggcaccttatttgcactcatgatcagtgttcaattacttcgcgcgatgcatttgcttgatactttaagggactggctcttagttaaatcacacgatacccgtcaaatgtgtcaattattcatcttactggcctttggtggctcaatgattttaactaacgacgttgcgatcctaacgttaattccaatctttctcacactcgcccggcggcagcacctggccattgcctacccaacgactttaattatcatggcagccaatcttggtagcgcgtttacgcccattggcaatccccaaaatttatttttggtcacgttctatcacgttaatctattcacgttttttaaattgtcgactccgttaatgcttgctagtctagctttattagttgccttaagccggcggttacctcggttgccgctaactgtaacaccaaccaaatctacgcccatttctcgcagtcaaatcgggcttgcgggcggcctgctcagtttcattatgcttggcatttttaatttggtgcccatttcactagttattatcggaacgattgtcgtaggcctcatgattaaccgacgcgtctttcagtacgttgattacgcactactcttaacctttatctgcttcttcatcttcgttagcgccatcagtcataatcccgcaataacgcattggctcaaccaattaactcagacagcccccagtgtctatattactggactaattactagccaagtcatcagcaatgttccagccgccatcttactagcgaatttcacgccccatttatcagcgctatttttaggcgtcaacatcggcggtctggggtcattggtggcctcactagcaaatctgcttgccttaaaacaattgttgcccttcaatgatgaacaaccactccaccattttttgatcgtgtttacggccctcaatggacttggcctgttcattttaggccttggtggctggttctatttacacctataattcagttacgctgagtaacgattcagtgagaacttgcaaaccaatcaacttgaaatagtgcgaaaaccagtaactagcgtgacatcataaaaggagcagtctcaatatcatgtgagcctgctccttttacgttctatctctgagatgtttagtgatacttagtgcgcctgatccaccaacatggccggagtgacgatttgctgaccatcgtagcggtgacccttgatcacgcgtttcgccctgacaaattcaccatcgaccgtcagcgttaacgcacaaattccaccatcaaacaggcctgaacgactgcctgcatcaattagatatcgtggaacgtcttgcgcatctgcctgcatctttaaataaccagtgtgtgaaccagtcaaggtctgcaccggcgtatgaccagtaatgatgactttattgaataagttccgatgccaacagtgactgccagtcgtgaagtcatcataatagtcatcccgaatccacagtaggtcagtcgttgtttgttgtgttaatgggtattgccagttaacacccgcgtgcatagccagtaaccgaccatgttgccacatcagcggcaaatgtgctaagaaatcagtatccggctttaatcgcgcaccatttaatgcccgccgaacatgattgggattggaggagtaaatccctaatttgcgccaggtccggtgaccaccgttcaacacccaagttgcggtggcattgtcatcaccatgagctgtccgtagccaaaattcatcatgattgccaagtaaagccacatcgccgtattcccgtacccgttttctaaccatcgtcagtacttttagcggcgccaacggagctgactcggtggcatgaccaaaatagcgtgccgccgtaccatcaatataatcgcccaagaaaatcaagcgcgtcgcggtaacttcaggatcggctaataaaactgccagatcatccgcggcactatgaatatcaccaataaacgtatacagcggcatattactccctccgtctcatcgataaccacgtgcattagtcgggtttaacgaccaccaataacatctgaaatccttgaacggcatataacgcgtgccgggcatccttaggaatcacgatcgattgtcccgcagttaaatgataaatggtgccttcaatcgtaatttccgcttctccacttaaaatattgaccatcgcatcgccctgggcagaatggccgccaatctcttggtcggttgcgactgaaaatagcgtcatacttaaatcatcccgttgaaccagtgtccggctattaacttgatcatcatccagtggaatttgttcagttaaattgaggaccttagcatgatcaattttgttaattaaactcatttgaattcctccgcatctcgctattaaggcctatttcgtttctaattgaataaactggcacggctgctcagcgaccaacgtatggaccgtatgagctggcaccactaacatctcgcccgcatgcacttcttggtcggtctccgtccaaacggacggtcaaagtaccatcaacaacctcaaataagcgggtcagcgtggattgttcagcactaatactttcacccgccgccattgcgtacatcgcaaacggcagttcaatccctaattttcgagcaaatgatttactagtaattgcatgctcccggtaagtcatcgtggtttttaaatcaattttagttaccgccatttcaaatcctccttggtcatcatcatggtcgcttacgttattcatgatggtatgatttcttaaattaagcttaacgctaacaaactcaattttcgaggttcgattgaataaacatcttataattctgaataactgactgctagtcatatacttaataaccacgtcatctctggcaggtaaatgcctttgaatccagatatgggccatgcaaaaaagctgcccaagcattattgcgacgctggacagcctgccgttactgcatttgataacagttctgtggaaaatttgatttattcagtcaactagttagggctggtagtgggacaaccaagggtacgcatacgtagcctcttcaaccaaatctcatagatcaagttccaatacgacttattttcgataataagccttggcccagcagttgcgacgctcccgacaccactgttcaaaagtacctacaaacatttggacatcttgcgcaggaattagttcttccgttcgctgcatgtgcacaatatcagatatcaccggatcaaaagtatacgtaacaaccagatgttgtgggattcttcgaataatcccaccgttacgagtaatctctaatcgcatcgtctccagctcaagttgaacttgcgaataagtctctctggagcaataatcgacaacatcatactgctcataacatcgtttataccaggcatgcgaattagccggcaaaacatcaaattcaccacgattcatacgatttcgaacagcacggttagcgcgcttctttccataacccatatgtgctttaaaaattggtgtgcttttataagaacgactcataataattgtgatggccgtcatgacgcgttaactagtacgtatttttaaaattaacaatgccagccattaacctcttccgtgtacttacggaataaataaattcattgaccagacctcctatcccatctggatcgtgccccaaatagaatactaaaacatatcacattattattgatgatggcaaataaacagaccgagacaaaaaaatccacttcgtgaagaatccgttacgcattcttcacgaagtggcactaccgccaatattaagataaatttaagccaataaaaaagtcgttacatcaagatcctaagacctgattaacgacgaaaggcgtaacaattgggctagctgggttcgaaccagcgcatcacgggatcaaaacccgttgccttaccacttggctatagcccaataatgaaatggaggggagtggattcgaaccaccgaacccgaaggagcggatttacagtccgccgcgtttagccagacttcgctacccctccgtaaatcattcaactatattagaatacataattttgaataaaaaatcaagacttttttcaaagttttttcagtttttatttcaaatccagaatttgcgtatcttgataccactccgccataaaattattggcttgccattcattgatacgcttgagtccatagcccactgcttggtcataataggtggtctgaccaaacacccgcggttgcggatgaacgtgcaaatgaccaaataaaacgtgcgccacgttaaactgctccaacagttgtcctaaccggggcgttcccattaacgcgttagccatattccaaaaccgattatcatcagaaaaacgcaaataatcgatccggggaacaaagtgcgtcataaaaataacttgcttgtgatccacagcagccaagttaagctgcgcttttacttggttgagcattaaatcagtccgctcctgatcgctcatcggctgtttaatagcccggtcgatccaaaacgcattcttccagtgtaagaagtcggccgcagtcgtatcagggacctgggcagcatactgatagtcataccacccattatgtccaatcacgcgccaatctgtaccagaaatatcgatataccggttatgcaggtagccatcaaaatgccctgtttcaagctcgtcaaacgaaatgccatggaccatgtcatgattacccgcaatccagtaaacacgcgtctgtgcgcctaatagggcctgtaaatcgacgacaaactgctgactacgctgaaagtcattaaaaagatcgccagcaatcaaataaatctgaacaccattctgtaaaagataggtcgcctgagatcgcatcatcgcagtcgcatccactcgattaacatcaaaatgattatcactactgaaagcaattcgtacgatggtcaacccctccaaaacaaaaaagatatgctaccactaagataacatatcttcgagtaaatattcaatttagcgaatgccttgcatcgaccgtttaatcattggcaccatcataaagaggataatccctaaaacgacactaacaatcccggtaatcgcaaaatatggcacttcggtttgcgtcgagtagaaacggacaatctgtgcattaagcgcactaccaaccgaatcagttaggaaccacatactcatcatctgagaagcaaaagcctttggtgcaagcttggtggtaactgataaaccaattggtgaaatcaacatttcagcaatttcaacgactgcccaactggcaactaaccaccatggactaaccttccctgcagttccaaagagcgctccaggtacagccatcactaggtaagaagccccagcgaatagcaacccaatcgcaaatttagttggtgaactaggttgttttttaccccacttagtccacaaccacacgaatggtgttgtataaatcatgatgaacaatgggtttagcatttggaaatcagaagcagctagatgggtaaaaccaagatccaaattaacccgattagctgcaaataacgcaagtacggacgaaccctgttcttcaattgcccagaataaagcagcggcaataaacaatgggatataagcccgaacacgtgaacgttctgttgcattagtcttgtcagacgttaacatcaaaataaagtaaacgattggtgtcaagataacaagcgtactaattaaactaataacatttgctaacgtaagagcattcattaattgcattaatagtagaatcaacccaatcccaacgattcctaagattgtccaccgcatgatttttttcaaatcaccgggttctaatggatcagttggatagaggctagcagaacttaaattcttcttaccatcaaagtagtattgcaatagaccaaagaacatcccaatcgcagctaaggagaagcctaagtggaagttaacatttaagccgatccgaccaactaaggctggtgcaaccaatgaacctaagttaatcccgaagacgaaaatactaaaaccagcatcccgacgtgtatcttctactgtatacaattgaccaaccatgtcagagacgtttggctttaataacccagtcccaatgacaataagtgcgattgaaacaaatagtgcgccaactccaaatggcgttgataacacgatgtggcctaacatgatgaagaccccaccaataaagacggtcttacggctaccccagacacggtcacttagaaagccaccgaggacactagaaacgtaaactaaggccgaatagattgacataatggatgctgcggtgacttggtcaaatccaagaccacctttagcgacactgtagtacatgtaatagatcagtagcgcacgcatcccgtagtaactgaatcgttcccacatttcagtgaagaacaacgtccgtaagccacggggttggccaaagaacgaccgatccagcttttgttccttatccaatagagattcctccaaacttcttaaccagtttgtatttcgtttaaaagtaacaagttttgtttcttaattaaacataataactattatactagccttaatcttaatcaacaatagcactaactgttttctaatctaataaccattaattaaattaatatccaccatacataaatagtcttaaatccttttatagcaccaaaaactagttgataggacattttataaggcttttagctttctaaaattaacactaaattctaatttaatataaaataattaatagcattcaaatgctgaaaatacgcaattggtattaaaaatctaattaaacaaaaaacaaaactgaaattatcaacaataaagtaccgctattaaaatggctatgattgttcgcagcatgtaatttacagttattgcgactaattataataaaccgcaagattgatatgctaagcatacctaaaaagcagtggcgacaataggcatcatcctactaagcccttacgatcattttgatacttcggcattcaaatagctaacattcttatatcaaaaaagcagctttgcgtttgcgcaaagctgccaatcattttatgtctatttaaaaataaaaaggcgagaaccacgtcccacctcacaagtgccggctaccagagtcgaactgatgaccctcggtttacgataccgatgctctaccaactgagctaagccggcatgatataaaaatagatgttaacacaattgccaacatctatgtcactccgacaggcgggctcgaaccgtcgacatcttgattaacagtcaagcgctctaccaactgagctatgtcggaataatcgcatggcaacgtcctaccctcgcagggagcgatcccccaactactctcggcgctaagaagcttaacttctgtgttcgacatgggaacaggtgtatccttctcgccatcgtcaccacactattgagaaacttgtgctctcaaaactagacaatatcaaatatcttcatatgaaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcggtttgcggtacgggtagttaagtactcactagaagcttttctcggcagtgtgacatcagacgcttcgctactaaatttcgctccccatcacagcttgtccttaaagtgaaaagcatttgactcttcacaagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcaggatcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacacctcatcccagcaattttcaacttacacgggttcggtcctccagtgcgttttaccgcaccttcaacctggacatggataggtcacctggtttcgggtctataacctcgtactcaaaacgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcctgctgctaatgagatgtttcagttcacagcgtttacctccaactagactatgaattcatctagtggtaacagttgattaaaactgctgggttgccccattcggaaatctccggatcatagcttacgtacagctccccgaagcatatcggtgttagtcccgtccttcatcggctcctagtgccaaggcattcaccatgcgcccttgttaacttaacctcatttacctaacggtaaatgcgattaatgagtttagcgataattaaacttcaataaaaaactcaaaaaacgcggtgttctcggtttcattatgaaaaaatatatttgatattatctagttttcaaagaacaagtttcaatgacgactaacgtcgtcaatggagaatagcgggatcgaaccgctgaccccctgcttgcaaagcaggtgctctcccagctgagctaattccccatgaggtattcaacttatggaaccaactggttcggttccaatgggcctaaatggacttgaaccatcgacctcacgcttatcaggcgtgcgctctaaaccagctgagctataggcccaaaaaacgcttattaaattgagagttagacctctcaaaactaaacaaagtttcgaagaatgtgtaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaaactcgaaccatgcggtccaagttgttatgcggtattagcatctgtttccaggtgttatcccccgcttctgggcaggtttcccacgtgttactcaccagttcgccactcgctcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaatcaagagaccctacacatttgattcgtcgaaactttgttcagttttcaaaggtctaaatcgttcgttgattacctcaacgcaacttaatcatcatatcaagttatcaacatcttgtcaacaactttttataattaattttcgttggaagcaagcggctaaccgctttgtgcgcctcaacaacgtatactaatttaccaattatcctgataaattgcaagccctaaaatgcaaaaataaccagtcaataatatcatgttaatcaatccactttgataatatacggtatttaaaaccataatcatgttaattgacttcaaatcctacctaccaccaccataaaatccgcttttacttaagtttagcctccaaatgtctcaacaatgttcgggtaaaaataatctaactttttttcaataaatcgctttccgaactaaagttactcaatctgacccaacaaaaacggcagttagcttaggaaaacctaagctaactgccgttttaaatctaattatttatcttcttctggacgcatcgttgggaaaagtaagacatcacgaatcgagtccgcatccgtcattaacataaccaaccgatcaatcccgatacctaacccaccagtaggcggcatcccgtattccaacgcctcgacaaagtcttcatcaatatgttcagcttcgtcgttaccagcagtccgttccgcagcctgagcttcgaaacgttgccgttggtcaattggatcattcaattcactgaacgcattggcgtattcattacctaagatgaagagttcaaaacgatcagtaaaccgtggatcttcttcattcttcttagctaatggcgaaatttcaactggatgaccataaacaaaggttggttcattcaacgtgtcttcaacaaattcttcaaagaacgcattaatgatatgaccaactttccagtatggttcatacttcacgtgatgttcatccgccaatttttgtgcatcttcaattgacattggttgccagaaatcaatcccagtcttttctttaatcgcatcgaccatgtgaatttgcttaaatggttgattgaaatcaactttttgatcatgataagtgacaatgccatcgtcagttacggcttgcgctgcggctttaaaaataccttccgtctcagccattacatcatggaagtcgaaataggcgacataagtttccatcatggtaaattcaggattatgttcacggtccatcccttcattacggaaaacccgaccaatctcataaaccttttccatgccaccaacgatcaggcgcttcaaatgtaattccaacgcaattcgtaagtagagatcaatgttcaacgcattgtggtgagtcacaaatggccgtgctgccgcaccaccagcttgattatgcaacattggcgtctcaacttctgtgaagccttgatcgtctaaatgatgccgaatcgctgaaataatcttcgtccgcttcaagaaacgatcaaagctatcgcggttagagatcaagtccaaataccgttggcgatagatctgttccacattctgtaacccatggaacttatctggcaatggtcgtaacgcctttgataagaacgttaaaccagttactttaatcgttaattcgccaaagtccgtcttaaaaacttggccggtaattccaaggaaatcaccaatatcagaacgcttgaagatatggtaagtatcttcgccgactacatctttacgaatgtataactgcatcttacctgagcgatcccagatatcagcaaaaccgactttacccttaccacgcttagctagcatccgtccagcaatggttgccaccacttgtttagcgtctagctcgtccttatccatatccccatacttgtcttgcaagtcctgggctaaatcagtccgttcgaaccggtgaccaaagggatcaatcccctcttcacgcagttcatccattttttcgcgacgaaccttcagttggtcgttcatcgtctgttcttgtcgtgccactagtgttcctccatttctagttagcgtacagatttattccgtacctaaacaatcactacatgttaattttgacaatcacgccgccaaaatgcaagttaattattcactttaccgcgtgactagccaaataagttgccgtctgctcctgaaactgcgttaaaatgcgcatcatttctgctaacgagcttgcctccattaaagccactttggtccgtgccgaccttgggatgccttttagatagtacggcgcttgttcacggaattcatgacagccgccccgctcaccttttaaaaccactaaccgctgcaaatgttccattgccgtttgcatcttagccatcggtgtgggtggcgttagtaactccccggttgctaaatagtgtactgtctgggtaagcatccacggattaccttctaccgcccggccaatcatgacggcatcggccccgacttcatcaagcatccgcgcagcatcttgaggtgtctgaacgtcaccattacccatcaatggaatcgtgagggcatccgccacccgttttaacacgtcccaatcagcatggccttggtacatctgcttacgagtccgtccatgcattgcaacggcagctgcaccagctcgttcggcagcccgcgcattctcgacggcatatacgtgctctgcgtcccaaccagttcgcatcttgaccgtcactggtttattaaccgcagcagtcacagccgcgaccatctcatagactttatctggacttaaaagccacttagcgcccgcatcagtcttaaccactttattcaccggacagcccatattaatatcaataatatcagcattggtctgctgatcgacaaactgggcggcttgaaccagtgttgctttcgaaccaccaaagatttgaatactcattggatgttcttttggatcaacaaacatcatttccagggtcttacgattatgatacatgatcccgcgatcagaaatcatctcacaaacgactaaccccgcaccaaaatccttgcagattactcgaaaggccgcgttagtcacgccggccatcggtgccactacgacacgattgggaatcgtcacatcaccgatctgccactcttgattcattaagcgtcacccttggaccgtgagagcactgcttctagttcgcgttcactgaactgatactggtccccacaaaaatgacaaactgccgtggcaccatgatcttcatcaatcattgcttgaacctcatgcttaggcaaagccattagtgcttcggcaaatcgttctttagaacaatcgcattcaaacttaactggcattttatctaataccttaacgtcaccatcaaataacaaatccaaaatatcttctggtgacttaccatcacgcatcaattgggagactaacggcatgtctttgagcttgttttctagcgagctgatggcttcatccgtcgcatttggcaatacttgcaccaaaaagccaccagcaactccaatcgaattgtcgtcatttacaaacaccgacaagccaacagctgatggaatctgttcggactgtgctaagtaatacgtaaagtcttcgcctaattcaccagaaactaacgcaaccgttccggtgaatggatccccaaccccctgatccttagtcacagataaaaagccatcagttccaacagccgccttcacatcgatcttatgcttatcattcaaaggcaagtgcacatgggggtgctgtaaataccccttgaccgtacctttagcattgccatcaacaacgataccaccaacaggaccgttcccgttgattttaacggtcatttgttcttcaccctttaaaaccgatgatgctaataataacgtaccaaccaagctgcggcctaacgctgctgatgctgcactccaggtatcatgtcggcgttgggcttcagcaaccacgcccgttgcgctaactgcgtacgctcgaaacatctcattacccgcgacgctttttactaaataatctgccatttaatcatactcctatctcaatccgtctttaattgcgacccgacgctcataaccgaattaacacaattgatttattttcctgaaatatcataacgcataaaaggagccgagacaaagtcccagctccttcattttactttattcaatactatgcttgcgaattagtatcatcctgcgatgatggtgtggcactttcagcatttggtaaaccggtggctgaagttgcgacatcactgtcggtagctgattcagtggctgaattagctgttgaattgacactactgtcagcactaacttctgaactagcatccgattcacttgggaaacttggttcagcaacactcacattagtcgtagtgtcagctgagtctgcttgcttatcatccgcactttggttttgcgcgtgcttttcagcttcgcgacgttccaattcacgtttggattcttcgaaggtagctgctttctcacttggaaattcattactatccttttcaggcatcttaccagtcttaaacagactgagaatttgcttttcatccaatgtttcgtacttcaataaggcttccgcaattaacttatgctgttcacggtgtgactcgataatatccgtagcagtttgatgcgcttcttggctcaaacgccggacttcatcatcgatcaattgtgccgtatgttgtgaaaaggcactcgcacccataccctgttggtaagctgcttgttggttggcattttctaactcaacaggaccaagcttttcactcatcccatattgagtaaccattgcccgggcaatttgcgttgcctgttcaaagtcattagaagcacctgatgattgcgccccaaagataatttcttcagcagcacgaccacccattaaaccagccatttgttccttcgcatcacgtttcgacatcaacatctgatcttcacgtggtaacatgatggcataaccgccagcacgaccccgtggcacgatcgttactttatgaacgacccgtgcatcattcaagaccaatccaacaatcgtatgaccagcttcgtgataagccacggtttcccgttcatgcttattcacaacgcgatcatgcttagcaggtccggcaatgacccgatcttctgcttcatcgagatccgcagcgtcaacttgcttcttattacgacgggcagctaacaaggccgcttcgttcaataagttttccaaatcggcacccacgaatccaggtgtttgcttggcaatttccttcaaatcaacgtcagctgctaatggcttattcttagcatggacttttaagatggcttcccgacccttaacgtctggacgaccaactaagatcttccggtcgaaacgacctggacgaagtaaggcaggatcaagtacatcagaacggtttgtcgccgccatgacgatgacaccttcattacctgtaaaaccatccatttcaactaacaattggttcagggtttgttcacgttcatcatgaccgccgcccataccattgccacgttgccgaccaaccgcatcaatttcatcaataaagatgatagatggggcgttcttcttagcttgttcgaataagtcccgaacccggctagcaccaaccccgacgaacatttcgacgaagtcagaaccagagattgagaagaatgggacaccagcttcaccggcaaccgctttagcaagcaacgttttaccagtaccaggaggcccctcgaggagtaccccagatgggatccgtgcacctaaggacacgaacttccgcggatctttcaagaattcgacaacttcgaccaattcttgcttttcttcttcttcaccggcaacatctgagaaacgaaccttattttgcttactatcagctggttttgctttggtcttaccaaagttcataacccggttgttcccgccgccttgtcctgcttgtcccatcatcatatagaagaggaataacatcaggatgactggcgcgatgtacattaataacgtgacccagatgccgctagattcttcggccttagccgtaaccttgacgtcatgcttagccgccaacttagaaacttggtcaaccgtggagttgttttccaacatcgttgttgaaaatgacgtcgtctttgtagatgcgctcttgataccaagggcgtttgcagaagaagtcgtccgtgctttccggtatgaaccagttaccttgtagacgccgccactaggctggatactaacgtttttaacgttattcttatctaattgtttgacaaattcgctataacgaatattttgcgtttgtgagccggaattaccgccaaagaaaaagtagataattcccatcaagctcagaaacatcaaaatgtaaaataagctattacgaaagagtccattgcgtcgattgttcatatgtgcctccttcatcgaaacttttatatacagtacttcgatagtctaaataatagcacatttgactatcattgaccaattatttatgctcgtaaatcgcaggttttaaaatcccaacgtacggcaagttccgatagcgttctgcatagtcaagaccgtaaccgaccacaaactcattcggtacttcaaaaccaatataatctgccttaatatcaacgagtcgaccagctggtttatccaataacgtgcagaccttaactgagttcacatcgcgccgcttcaacaaatcgatcaagaacttcaacgtccgcccggtatcaatgatgtcttcaatgactaacacatcacgacccgtcacatcagcatctaagtccttcgttagttgaacctcaccactagagatcgtttcattaccgtaacttgataaattaataaaatcaagatccgcgtaaatatccatttcacgaataatgtccgtggtaaataaaacggcacccttgagtacgcaaataattaatgggttcttaccagcatatgcagttgtgagttcttttcctaatttttgtgcaacctgatggatatcctcgcgactataaagtactcgttcaatgtcgttgttcatcgtttcagatgtactcctttcaactctcgtgttttaaggctaaaaatactgtctgggtaccagtcgtacgatagctaaacttatgaccgaccacccacagaacgttcccttgagcattcactaacacttgcacctgttcacgccgttcagccggaacttttcgatcaatcagcagtcgacgtaccagctgatgaccaccgcccttgagaacgattcgatcaccagcttgccacggccgccacactagcggccaatcggcttctgttaaccaaaatggctgactgacaacatttggcacccgcgtaaagattcccaccgtttgggttgcagtaattttctgccattggtttaagtctaccataattttttcacggggcattaactttttaccccttttttttattggcaaagcttcaatgataccagcgttacggtacaactcccaggccgcgtttaccgttaatctactcgtggcaggccgcgtccgttgtccccacgagaccagcggttgtaacttcgactcggtgaatagttgttgcgtctgctgctcgagccacgtcgcaaaaacggctaactgccactggctcgggagtgcgccccactgatcaacaaccaacgcccctgtggccgttacgacctgcgacagtagtaccgtgaccatttgctttttagccgtcaacagcgttgtcaactgttgctggtaatcggccacatgctttaataactggggattaaccgtcataagttctggcacgacacggtgccgaatccgattacgggtcaaggccacatcttgattagtaacgtcttcaaaataaacgacatgctgctcggcagcatagtttcgtagctgatctttcgaccacgtcaacaacggccgaattaatcggcccgttgcaaagggccgactagttgcgattcctgtcaattgtgagatgtcgccaccacgcgcaagcttcatcagatacgtttcgacttgatcattggcgtggtgcgcagtcaaaactgccgttgcacgattttcccgcatcaccttagcaaaaacatggtaccgaaactgacgcccagctgcttcaataccactcttgggatgtgccgcgggtagccaatcggccatgactagcttcaagttttgctgctggcaatattgtcgcaagtagtccgcttccatttgactttgttcgcgtaaatgatgattaacatgagccaccactacccgtggccgttccgctgctggcaatcgttgcaacaaatgcaacaataccattgaatcgaccccagtcgacaccgctaccaccactgtttgctgtggtgataacagtttggctgcagctaattgccgattgaacttttgaattggtgtcatcttaacctcccatctaacttcattataaatacattggatttatttattgttaaaacttgccgattagttggctggtcgtttgtcacctatttgaacattattccgactggatagcataagatgaactagccaagcaagtttacagtaactcacaccgtttccaacgtgtctcgctgactgaccttgaacaatcggcaattttcaataaaaaaagcacggtcgtgactctaaatagccgcaccgtgcttcaaaatttaactagattaatggcaagtcactaagtttagctacgacgaccaccacggccaccacgcttaccttcagtattacgctttaaggttgctagccgatcctcgctatcttttaagaagccagacatcaatgaatcaaagtcctgcttcttaggttcatgttgtcgtgattggtaacgaccgccgccatttcccccacgactatggaaattatttgaccgatcgtgatgattgccattgctttgacgttcaccatgaccatggttgttaccttgatgattgtttggccggttgccaccctgatggttgccatgatgttcatgttcaccttgaggtttgtcaaccgctttacggattgacaagccaatcttaccgtcatcaccaacggataacactttgactgtaacatcgtcgcccacgctcaagacatcatgaatgtcctttacaaagccatcggaaacctcactgatgtgtactagccccgtttgattattacccaagtttacaaatgcaccaaaattagtaatcccagataccttaccagtgacttttgtacctacttcaattgccataaaaaaagttgttcctcctatgaaataatggttttagtatagcatactttgtgaaacgttgagttatacatttaagcaattaataaaaagtggtctactcatataaagcagaccacaaccccgattagttggcagttacatcggcagcattatcatttggtaagctgtagaccgtttcgccactcttcgtataatcatactttgaacgtaataacttttgtaagtaatccttattattcaactgtttgatctgactctcaagttgattatttttttgctgcaccttttttaatttaacttgactggtcgcaacttgacggtttacctggtgcagattggaccgcgtattaatcaactgaaaaccaaagaatagtatcaatgctccgaacaccgcaacaatcaaaataaaccgtcgccgccgtacttgtgtaacacgctgggcttgcccatgctcgtcggtggcaacttgacgaatataatcattatctaactgcttgattttgttacgtgacccgttcgtcatgttggtccagtcctttcaaattgggttgcctaaattataacaacttcatcggccggtgtaaacgacatcatgctgattaagtcaacgtttacgaccatttcgatgaacggatacaccgacctaatcactaaatggttggcgataatccgttttgtagtcttcgctgatgatgtcatacatcagctcggcatcatttttcttagttgtttccaataactgcgtcactttgactgttaatgtcttatttccaaaactaataattagttcatcatcaacgctaacattactggaagatttcgctaccttaccgttaatttgaatccgccccttatcggcgatttctttagcaacagagcgccgcttgatgattcgtgaaacctttaaaaacttatctaaacgcatactcatgaatgatgttcctttccttttgcaacggccttaattagccgctttccatatggcaacactaaccactcgcgaatcgtgaataatcgggcatagacggccccggcaacaaacaccagcacaccgattagcaccccaatcaccgttataattccagccattccacgcgtattcgctagtatcggacctactaaggcggtgatttgatgacaactaaggatcaccacgatacccattacggcacttaatgcgagcaattttatcaaataaccactctctaatagcacctgctgcaagtcttccggcgaacctaaccacatgaccgcaaacatcacggccaagctcaatacggtcaccgcactggcaccgttgatgccatagtggaccacgaagatgtaattagccagcacttttgtcgctaatccagcaatgatgccaatgatcatggccgtatattcgttcaaactctgtaacacacttgtatacgtcgtaatcaacgctgcaaataaaatactaataatatagattcgcaatgccgttgttccttctaatgaaccaaataacaagcgattgatttgtggcatcaacgcaactagaccgaccgtcgctgccattgataatgctaaactaacgtgaaccatcgcctgtgtctggcgcttgaattcaatcggttgacgcttggctaacgcatccgtcaaagcaggcaataacgttgctgaaaaggccgtcgccaccaccaaccctaactgaaccaaaggttgaccacgatcgtagaccccttttagtgccttggctacttctggtaactgaccttgatgcaccaagccccgcataaccgtaaatgaatccactaattgcagtaagataacgacagcggcgacaagacacagcgtcccaccttcaattacaaatcttttggttaatttgcgataactaggtaacgggtgggtcggtgcgggtgcgggcgccaataaatagcgtagaccaaaagcagtaaaaatcagtgatgaacagattgcagctagtggcgctgaactcattgcccacgttcccatccgataattatcccaaccgagacggacactgaaatatgcagccatgatgataattgcgacccgtacgacctgttcgatcagttgggacactgcggtcggtcccatcaaaaattttccttgatagtaaccacggccggttgctaaccatggcataaagacaaacatccaagccacggcactaatgattggtgctagattaacgtcacccatgtgggccgcaatccacgttgcaccaagctgcaagccgaaaaagacgaccaacgataatccggataagatatgaaacgcccgccgtgcaatcagcgacttactcgtttcgtctggctgttctgccactaacttagaaataaaatttggaaatccatttaatgcaaaggtcatgccaatgccgtacagcggataaatctgctgataaacgtaaaatcccgtattaccaaccatgttctgtaagggaatccggtataccgcgcttaaaatcttagcgactaatgatgatatcgataaaattaacgcacctttgaacacggtgttcaagtgatcctttggcataacaaatcccttctaccgagcaactcggtgtctcatactaattcatttgagccgcgccctgactagccaggacaacgccccatcagacgataattcctgctatttgccattggttccactcgatagcgcttaacccaccccgtgcaaccatgcttcataacaacaactaccgagctaagacgcactagcgacatcgtcttcggctaagatcaaactcagttgttcgacaaactgtgttaattgcgccagccactcatcctgttgcatctttggctgaatgactaatttaaccttcattttatcatcatcaattccaactgtcgcttttaattttgtttttgccaaggccttaaaaatatctttagtatctagcttagccgtcccttgtttggataacgttaggtgtagctcactatcgtcacgctgaatcttctcaatcagcgcgtcatccgccagtaacttcagcttacctactgctaatagtccagcgacttctaccggataatcaccaaatcgatccattaaatcatcctgaacttccatgtactgatcattattctccagctggcgaatccgtttataaatttcgatcttttgccgttcatcttcaatatagctggtcggcaagtaggcttcgattccaagttcgaccgtggcatcggtcttaactttagccgcctgaccacgcttcttcgccactgcttctgacaacatctgggtatagaggtcataaccaactgagtcaataaagccgtgctgttgcttacctaacaagttaccagcaccccgaatcgacaagtcgcgcatcgcgattttaaagccagatccaagttccgtaaagtccttgatggcctgtaaccgtttctcaccaacttctgtcaaaactttattttgctgataagtaaagtaagcataggcgacccgactactccgaccaatccggccacgcaactggtatagctgtgacagtcccatccggtcagcattttccacaaataaggtgttgacgtttggaatatcaaccccggtctcaatgatcgttgttgtcactaacacatcgtactcaccccgaatgaaatcgtagagaatcccttcgagttgtgactcaggcatctgaccatcaatatgggccaccgccgcgtcaggaaccaagtctttgatctgtgcaacgactttatcaatatcatgaacccggttatgcaaataaaaaacctgcccattacgttgcatttctcgttcaattccctctttaatgacgccaaaattctgttccatgacgtacgtttggatcggataacggttcgttggcggcgtctcaatcactgataagtcccgtacaccgagcatcgacatgtgtaatgttcgcggaatcggcgttgccgttaacgtcaagacatccacactagccttcaaggccttcagtcgttccttatgcttgaccccaaaccgttgttcctcatcaataatgagcaggcccagatcagcaaacgcgacgtccttagacagtaagcggtgcgtaccaaccacgatgtcaatttcaccactctttaactgttggaccgtctctttcatttccttagttgttctgaatcgtgacagcatgccaacgttaatcgggtagccttcaaaccgattcagcatcgtttcataatgttgctgagctaaaatggtcgttggcactagaaaggccacttgtttgccggcctcaatcgccttaaacgcggcccgcaacgcgacttccgtcttcccataaccaacatcgccgaccaataggcggtccatcggtttcggtcgttccatatcatgcttgatttcattaatactacgaatttgatccggcgtctctgggtacggaaaatcgttatcgaaatcatcttgataactatcgtccggtggaaaggcgtaacctttctccgcctctcgcttggcatacaggtcgactagttcatccgcgatatcttcaattttcgccgcgactttgcgcttcgctttcgtccattcggtaccacccaacttattgatgcgtggcgtctttgattctgacgaaacgtacttttgaactaggtttaactgggtcacgggaataaagatcttcgcattattttgatacgcaatcgtaatgtagtcttgatggacaccatcaacttccagcgtctccataccaacgtactttccgatcccgtgattgacgtgcacgacgtaatcgccgggtttgagatccgtataactcttcaaccgttcggcattagccaaggtctgacgacgtggacgcttcttagccaccttcttgaacatttcttgctcggttacgatgactaatttaccatccggaaactcaaatccattttgcaagctaccttgcacgatttgaaccgcacccggttgtaaattagtggccttagtcatgaccgcttcaatttcaaaatcatcaagcgtatcactgacctttgtcagacgctcagcctctgataccatcaagaccaccgtctgtttaagcttatgccaccgatccagttcggtcttcaacgctgggagctgcccaaaaaattcctgcatcgggcgtgtgcgcacgttagtgacttgcgctagtttgacgttaccgatgcccttttgaaacagcgaaatcaagagttgtgcatgttggtcatcccggagcaaatcccgaatatcattgccgtaactcgcagttgccagcacccggtgatgtgccaattggtccgtaacccagtcagcttcttgcgttaataactgctgctcactatcaagcaaacgcgaatattcttcgaagataacgagcccgtcagcggccacatagtcaaaaatactcgttttccggtcgtataaataatcgccatataacaataaatcgtttccgataattcctttttccatgtcagctaaaggttgtgctaaattatcggccaaagtctggcgttcggctggcttgagtttcttactttcagccgcaatcgccgttttaagacgctgtgccccggcctgcagcatagctgttgtcaggataaaatcggtagctggcaaaattgtatactcatccaagttttccaccgaacgttgcgttcccgggtcaaaatacttcagtgtatcaacttcagtatcaaagaagtccagtcgtaaagggtagtccgcatctaacgggtaaatatccacgattgagccccgtaccgcaaaatctcctgggcgtgcgactaacttttccttaacgtaacccatgtcgtgtagttgccgctgcaagtcttccaaatcaatatcttgaccaacggctaccggtaacgtggctgcttgaaattgtgcgacgggcggcaagaaccgccgggcacctgcaaccgaggtcacgatcactgccggactgtcacgcaataaggcgtttaaagcctggacccgttgcgctcgtgactctggtgaacttgtcgcaacctccgtcgcaatcatttcttcagctgggaataaaaaaacttggtcttcatctaagagactcgttaaatcatccactagctgactcgcgtgaaaaccgttatcggtcacgatcagtaatgaatgcgttaattggtgaaatagcgcgcttaaataaaccgttcgtgccgaaccgttcaatccggtgattagttgccgactacgcgggctgatacctgctaaaattgtttgaaagtcgggcgtttgctcaacaatcgtttcaatatccattctgtcgtttcctcccgggctagttatattgattcataactgccgcaaaatcatcatttgctaaccaagcttcgaccgccgctagcgccgtaatcttagcatcgtcaaacttcgccacttcggctggcgtaaatttccccaacacgtaatcaacaacactcatcttctgaggatggtcaataccaactttaacgcgcttgaagtgctgatcgccaacatgactaataatgctcttgatgccattatgaccacccgccgatcccttttgtttgaggcgtacttttcctaatggcaaatctaaatcatcatgtataacgagcaaatcagcaggatcaacattgtaatagctcatcaacggtcccaccgctcgtccagaatcattcatataagtggcgggtttcaccagtaaaatcttctcaccgtcttgaaaagccgttgccacctgtgcttcaaatttactcgtttgaaacgtaacgtttagtttgctagctaattcgtccacaatcataaaaccaacattatgacgtgtctgggcatattgccgcccaatgttgcctaacccaacgatcattttcataattttatcttctcctattactttgcataccaaaacaggccgaaccggtaatcgacccgattcggcaactctgagtaacgataccacctaagtcgtattggcaccgctactcacaccgtgaccgacgcgcccgccagtcaagtgttcaaaagttagcgtttattaagtgcgataagtataccacaaagggcttattgacgcccgccaaagggttttgcggacattgttaataattgtattaaaagcatgctcaatctaacacttattttgcacaaacatggtatactttaaccgtaaaaactaaattttcactacgagaggatgacttattttgtcaagcatgccaaatcatcaaaaagttgtgttagtcggcgacggcgctgttggttctagttacgcttttgccatggcacaacaaggaattgctgaagaatttgtaattgtcgatgttgttaaagatcggacaaagggtgacgcccttgatcttgaagacgcccaagcattcaccgctcccaagaagatttactcaggcgaatattcagattgtaaggacgctgacttagttgttattacagccggtgcgcctcaaaagcctggtgaatcacgtttagacttagttaacaagaatttaaatatcctatcatccattgtcaaaccagttgttgactccggctttgacggcatcttcttagttgctgctaaccctgttgacatcttaacttacgctacttggaaattctcaggtttcccaaaggatcgtgtcattggttcagggacttccttagactcttcacgtttacgcgttgcgttaggcaaacaattcaatgttgatcctcgttccgttgatgcttacatcatgggtgaacacggtgattctgaatttgctgcttactcaactgcaaccatcgggacacgtccagttcgcgatgtcgctaaggaacaaggcgtttctgacgaagatttagccaagttagaagatggtgttcgtaacaaagcttacgacatcatcaacttgaagggtgccacgttctacggtatcgggactgctttaatgcggatttccaaagccattttacgtgatgaaaatgccgttttaccagtaggtgcctacatggacggccaatacggcttaaacgacatttatatcgggactccggctgtgattggtggaactggtttgaaacaaatcatcgaatcaccactttcagctgacgaactcaagaagatgcaagattccgccgcaactttgaaaaaagtgcttaacgacggtttagctgaattagaaaataaataatcatttcatacgattaagtgtatgatgaacgctcgtctatagcagacgggcgtttttttgtttgcttgagggtaccttagcgattcattaaagcgcaacacgcactaaaggctatttttaaaactttcttatcacgattaccggccttgaagtttgcactcatctcacttctgttataaggtgagaatattacgaatatatggaggaccaacttaattatgaaacataaacgtggacttatgattgggggcagtatcctcggtctcctcgtcatcggatatgttgccacgagcttaatctggcaacatcaacaaacgttcctcagtaatacgtcggtcgctggtgttgacgtcagtggtaaaaccgccgctcaagcagcaccgaaagttaatcgcgctttagaacatcgcacttatcgaattattgaaaacggccaaacaaagtactcatttaccagcaaatcagccggtattacaatcaatactaaaaaagatttaaccaaattagtgaccaaacaaaactactggcgttggccccttgcactattgcaatcggctcaggctgatgatagctcagcggttggacaactaaccatcaatcacactgatttgaaaaccctactacaaaaaatcaccacgactgccaatcaaaccaaacgaacaaaaactgaaaacgccaagttagtttatcaacataaccaagttgagattaagaaagaagttcaaggaaccgaattagatcaagctaaacttaagacggtcgtcaccaaagcaattagtaatggtgacagtcatatcacccttaaagacgcctacgtcactccgaccgttaccagcacgagtgctagtttaaagacggccaaagtaaaatcagcgaaatacgctaccgaaaaggccacctataatatcaacggtcataaattcacgattcctcacgacctaattctcagttggattaaagtcgataagcaaggcaaagtgagtttagaccaaaacgctgttctgacttacgtgaagcaattgaatgataagtatcatacctatcatacgacgcgtcagttcaagagtacggcgcgtgggaccgtatccgtcagcggtgggttttatggctggaccattaagaccgaagcagaggccaaagcccttgctactgaaattttgaaaggcaaggactttacccgctcaccaatcaccagtggttccggatataacaacaagggcaccgacatcggcaacacctacgtcgaagttgataaagaaaatcagcatatgtacgtctacgttgatgggaagctcaaagtttcaacggacatcgttactggaaagcccggtaaacacgctacaacaacgggtgtttggtacatctggaataaggaaaagaacgcgacccttaaaggtgataatgacgatggctcaagttattcccaaccagtttcttattggatgccgttcgatgacactggcgaaggaattcacgattcttcatggcaaactcaatatggtggtacttggtacaagaagcacggctcgcatggttgtgtgaacaccccaccttctgtcatgaaaaaagtttttgctgccgtgccagtcggaacaccagtcattgttttctaatttaaatctaatttaaccaagtcggtctgaatgttatcaggccggctttttcatcccttttagccgtcgtttgatgtcataatgatacgtgtaagcggtcgttttatggtattatttattaaaacaaactaataaatctgggggaccaactgctatgctattaaaaacactcgtaaagcctaaagaacgcctcgtcaccattacggcggacgcgaccttagaggacgccttaaaagtcttggaggattccggcttccgctgtattccaatcttagatgaaaccggtcatatcttccgcggcaacatctataagatgcacatctatcggcacaagtctcggggcggcgacatgtcgcttcccgtgacgaccctgcttaaaaatgccacgaaaacgattcaagtcgactccgccttctacaatatcttcttctccatcaaagatttgccatacattgcggtgctcgatgaacacggctatttctatggcattctcactcatacgcgtctgctcgacatgctctcacaatcttggaacgttaacgttggtagctatgttttaacagttgtctccgttggtgaacgcggcgaccttgcagccatggctaagattatcacgaaatatacttcaatcgccggctgcctgaccttagacgtccaaaacgggacactcggttatcggacgctctttaccttgccagaaaatgtcgacagtgaaaagctcaaacgaattatcgacaacttgaatcgcaaacaatttaaagtcatcgaagtggaagatttacaagctgaataatcacagttgccccaaggttaccttggggcttttttaatgagatgaattttcagatcaaaagcgaccagcttaagactgctgaaaacagttcgaattagcgtaaacctgtctggctgaagcgtcctaccaccgacttacaggcatttttgtcaattgtcggaacgtggtgggcgcagatttgagtcaaaatatcgcgtctcaaatgctggccgttcactccctaatgccatattgacgaaacgtgttcgggtcagctgtgttccagcaattggcacccagctccggaagtcttagtagaacacacactggaatcttgatgaagcattaaattatcgctgactaatttcaaactatttaaatctacctgctaattttaacgaccaatatcatttatctaaaatcgtttgacaaacataatagtcaacgataaagtagtcaacattaaataaagattagaaaataattaaacgcgacgattaggaaagtagcacttaagcaattgttcagagaggttccggttggtgaaaggaattcatattgctatcttgtgaaaatcccctaatcacggtaagtgcgatcattatttgtgagtacttaatggcagcatccattatcatgctagcgcatcgtcacttaacttaccgtgcgtgaagtgaggccagtttactggcaaataataggtggtaccgcggaaacgccctatatcaatcaactacttgattggtatagggcgtttttattgtctaatcgaaggaggaatttctatgttaacaggaactcatttaatacagctaaaaaatggttttcatttatttactcggacagttggtcacgggccagtcaaagtattatgcgttcacggtggccctggtagtaatcatactgaatttgaaaactttgccactgagctaggtgaagaaaattttcaaatcagcatgtatgatcaattaggctccttttactcagatcaacctgacttttcaaggcctgaaaatcaacagttcttgtctttggattattatttgtctgaattagaagaagtccgccagcagctcggactcgaagacttttacttacttggtcactcgtgggggggcttattggctcaagaatatgctctgaaatatggtcagcacctcaaaggcttaattatcatgagtatgattgataacatcgctgaatacacaccacacgtcaataaattgcgcgaacaaacgttaatagcgagccaagttagctatatgcaagatattgaaaacgcggaggcctttgatgatccagaatacaaaagccttgtcacgactctcaaccggcacttcgtttgtcgtcatccggaaaatgcgcctcgtcaattagtctcaacactagctacccctgtttataattattttcagggcaataacgaattcgtgatggttggggcattaaatggctgggatcaacgtgcaaacctccataaaatcatgacacctactttactcacttttggggaatacgacacgatgccgctatcagttgcccggcgtatgcagcgaactcttccaaaggcacggttaactttaacgccagatggtggtcattgtcatagtgtagataatcccaccgctttcttccatagcttgagacgctatctcaccgatgtcgaaaccaatcaatttacagcatattaattgaggaggaacgctaatgttgatgaaaaaattgacaactattagttgccttttactagtactaagtagtctaaccgcttgtgggcaagcacatgccaatgtcacaaccaccaggaaaaccctgcatttgatgcaggatagtgaattaacctcattggatacctcaaatacagccacacttacacaatggaacgtcttacaacaatccatggaaggcctctatcgcatgaacgctcagaataaagtggtcggtgcaatggccactaaagtcgttaaaacaacaaatcatggcaaaacctacacctttcacttacgacgaaatgcaaagtggagtaatggtcacaccgtcactgccaaagatttcgtaacagcttggcaacgctctgtcagtgccacttctacctctggttatagttacatatacgaaggtatcaaaaacgctgctcaaatttcagccggacataaatctgttaaatcattgggcgttactgcagtgaataagcacactttaaaagttacgctcagccacgccatgccatacttgagtaagatgctcaccatgcccgctttctttccccaggatcatcaagtggtgtccaaatacgggaaagattacggaactactagtacaaaaatggcctacaatggcccgttcgccgttaaaggttggaacgggactaatgattcttggaatttgttaaaaaatacatactattacgataaaagtgacatcaagttaaataaaataacaatgcaagttgtcaaagactccacaactgcccataatctcttctcacaaaataaattagatgacgctactgtcaccggcgtcaccgcgcagggtgttcaaaatgactcgcatctgaaacacgtcagtaaagctggcacttattatttacgtctcaacatgcaaaaaaatcgggctttaaacaatcaatatttacgtcaagccttgaatcttgtgcttaataaaaaaacactcaccaaaaatattttgagtgatggttcaacacctgcttacaattatgtcacaccaggtttaaccaccgatcccactacgggcaaggattttggtactgaaactcaaagcacctaccgacacaatgttgctaaagcacaagtattatggaataagggtctcaagcaacttgaccgttcttctgtaacattaaagctagttagtgatgacacgacggtcgctaagaatattgaccagtttgttcaagccgctgtagcacaaaacctgaaacatgccaaaatgtcagtttcagcgataccttcaaaggcctccggcgaagcagttactaacggaaattacgatttgacttatacactctggctagcagactacgcggacccgatttcctttttcgacattctgacaaagaacaatccgcaaaactacgggcactatgatgacactgttttcaatcaacaaatcaccgctgcacacaaccagaacgcaactaacacacaatcatactggcaaaatatgagaactgccgccaaacgtctcaaccaaacagcagcagtcgtaccgctttacaacatgactgaaagtcaccttgtaaattctaatttaaatggtgtcagctatcatgcggttggcgaaaacgattatacgcgtgcttacttcaaataattgtctgggttctgaaataaacaccagtcattatgcactatatctgcccataatgaactctcatcgccaacttcactatgagtcgattagattattttgttcaactgacatcgtaatgactcgacaaaaaaaccattatttcaatgactcatccttcatcgaaataacggtttttagtctgatttgtaaaaatcacaccctactgaatccggtcactaaagtgcaagacccgatccaagctgtacataattggcgcggtgatactcatgataatcaactctgataaagcagttgttagatacgtcggccagaaagcgacgccgctactcatcatggtaatcatcagtgcgatcataaacatcgaaacggtgaatagcgcgatattcagtaacatccgttgccaaaccgtcttcaacttaggggccaaccacgtcaataccagcagggctaataatgattggccgccaccaaagagaacgttgaggagactcgcaccgggaccaaaagcgtcaaacaaaataacgccagcaacaattccccaaatatacttgcgattgaacacggctaagtggttcaacccttcagaaacgcggaattgaattgcgcccgatgctaagctaaaagctgcggggcctaggcatagtacaacatacattgcagcgactagggcgttgataatccatggtcgaatttttgattgtgtcattcgcttaattcctcctagtttttttaacgtgggatggttacgaaccacgtattgattgaaacaaagcgaacataatcgtagcacgctctagtagttcccgcaagcttgctaattgaaaatgctggtaggaatgaataagttacctaatgtagccgccattaccgccttaattgctggcatccggttgccggcctcttcaaagacgaccgcctgcttactctggaagacatcatccgtaatttcaaacgccgtcattccgtactgttcgcctaatttggctcccagctgcgtctttagatcgtgtagtgctggtaagcaatgcatgacaatcgtcgatgacttgccagtagctgcgagtaacgcagtattaatttgaaacggcaatagttgcttgatccgctcaccatagtcgacctgctcgcccattgagacccagacatccgtataaagcgcatcagcctgagtaacggcttgttgcggatcagccgtaatcacgaccgtgctcccagctgcctgcgcatactgttgggccaacgcgaccactgctggggctggctgtaacgctaccggggccccgatagcgatattgatgccgagcatcgctcccgccacaagtaaactattagccatattattgcgaccatcaccaacgtacgctaacgtcaacccttttaaatgaccaaaatgttcctttaatgttaaaaaatccgctaaaatctgcgtcgggtgccactcatcggtcaatccgttccagactggcacaccactataggtcgctaagtcttcgaccgtgctttgtttaaagccccgaaattcaataccatcatacatggaccccagtactttcgccgtatcaacaactgactccttcgtcccgaattggatgtcgtccttacccaaaaactctggattcgcgcccagatcattagccgccacagtaaacgcagaacgtgtccgtgtcgacgttttttcaaacagcaacgcaatattttttccttgtaaataagggtgtgggatatggtgtgctttaagggtcttcaagtgactagcaaagtcaattaagtaagctaattctgttggtgtatagtcgatttccttcaagaatgaccgaccttcaaattgattattcattcgtcgtgacctccgttgtcaaagttgtcagtacctttgcaatcaaggcaatcccagctaataaatcggccggttgcatcacaattgggggtaacaaacgtaacgtattatcgccagctgataacgtcaataagccttctacttgtagccgggtaatgacttgattaaccgggatttgttcatctaagtggattccaatcattaggcccttccccgtgatttgtttaactaccggtatcagttcgacttgagtcgctagggcttgccagacaagttcggcatgggcccgaaccgtcgttaacagcgccggtgttaattgggtcaagacacgttttgccgccgccatagcaacagcattaccggcgaacgtcgagccatggctgcccggaccaaaggcagtggctaattgccgccgaccaaccattgcccccattggcaagccattcgctaagcccttggcgaccgtgtagatatcaggatccaggccgtaaccttcataggccatccggtaaccagtccgaccgattcccgtctgcacctcatcaataatcaacaaaacacccgttgcttggcatttcgcattaaccgcttgtaaccaagctgtttgtcccgcaaagacgccgccttcaccttgaacgacttctaaaataacggccgccaactctggtgtgattttgtccaaagccgcgtcgtcattataggttgcaaacgtgatgccaggcactaatggcgcatagccagcctgaatatgaggattgcccgtcatcgacatagcgccataggttcgaccgtgaaatgaatgctgaaaagctaaaatgccggttttacccgtgtacttccgtgcgagttttaatgcagcttcattggcttcggttccggaatttgcaaagtatacgagtcgctcttcaccattcgctaacaggccggcaacggcatcttgtaattcattttcgtataaattcgacgtatgccagatatgcgtcaactgctgggtgacggccgcctgaatttgtggttggtgatacccaaagttgcagaccccgattcccgccgtaaaatctaaatacgtcttgccatgattatcagtcagatgaacgccctgaccatccgtaatggcaaatggaaaacgttgataggttggaaacacgtgttgcatggtcatacggccacctcctgaataattgcggttcctggttgatcgattgcattcgtaataatagcctgcttgactcccgtctgaatcgcggcaattgcagcttgaactttgggttgcattcccgcggtgatcacagctgttcgaatcaattgctgagcttgttgtggcgatagtgatgtcatcacattaccgtgatgtataattcccgggacatcggttagcaaaaccaatttttcagcatgtagttgttgggctagcacggtcgctgccatatccgcattgacattgagccattgtcccgtctcggttaaggctaaaggggccaaaataccgatatgatgagccaacaattgcattaattgcacttgattgacagcggtgagccgaccgacataccctagctgtcgataatcaatcaattcaccagttagtaactgattatccgccgcattgagccccaacacaggtaggtgatgttgtgttaattttgcaagtaaggctggttgcacatctcctagcagggccaacttggtgagcactaaggtcgccgcatccgtcacccgcaacccgttcaccttatgcacgggcaaagcaagctgagtcgtcagtcgattgatcattggccccccaccgtgtacgatcagaatctgataatgctgttggtaccactgtgcgatttggtcaaagaaagtggtgctcaattggctaatcgcctggcccccaatcttaattacaattaattttgtcattttcaccacctccgtttaagtatgatagctcgcgttaattttgacgtaattgtaagtcaagtcacaaccccaagcctgaccacttgctgtaccgtgatgtaaatcaacatcgatcataatctggttatcacgtaaggtcgcctgcaccgctgccatatcaaagtcaacggccagactttgttgaacaagtaaaacgccgttcatttcaatatcgaccgtcgccacatcgatgtctgcatcagtggcgccaatcgtgctaatgattcgcccccaattcgggtcttcaccgaaaatggccgccttaacgaggttagagccaacaattgctttggcgatttgctgaccatcaaacgttgtagcggcgtggaccacattacattcgactaacttggtcgcaccctcaccgtcagcggcaatttgcttggcaagttggcctaagacatagtgcaacgcctgattaaaaatatcatagtcggtggtacccacttgtaaactcggattatctgccagaccattcgccaacgtgaccaccatgtcattagtagacgtgtcaccgtcaacagtaatttgattgaatgtctgatcaacgttagtacttagcatgtcctgtaaaactggcccgtctatttgggcatcggtggtgacaaaaccaagcatggttgccatcttgggatgaatcattccagaacctttggcaaaaccggtcaaggtaactaactggccgctgagttcacactgcacacagacggtttttggatgctggtctgtcgttaacacggcgtaggtcaccgcgtcactcttcgttggtgtcaattgcggcaagccgtttttgattttatccatgggtaactgagcaccaatcagcccagttgaagcaacgccaatcaagttcggcgccacgtttagtttattcgctaaccaggcttgttcttgcagcgcattctgccacccctgctcgccagtacaagaattggcgattgcactattcagcagcagtccctgtaattggtggccctggtcgatcatctgtttagttaacttagttggtgctgcctgaaactgattcgtcgtataagttccagccgcactggcaggcacttttgaaaatagccaaccaaaatcttttttatgacgacgaagaccaatatgaatgccatcactgtaaaaacctgccggccactgaaaggcaaccgtttcaaacttcgtattcgttaaaacttgcatctgcataacttcctctcttattgcaccttatcagggaaatacaggtaacgtcggtaatccggccgtaaccgcgaaatcaaaatagcgattaaaattctgaacggcctgccccgcagcacctttcatcaaattgtcaatgacgctcacaaccacgatggtgttcgtgaccggattataatcaacgcctaacgcacagttattagacccaacaacgtccttgagcgtcggcatccccgttggtagcacttgcacgaacggctgctcatgataggtcgcggtaaaagcagcgcggacctgcgtcgttgtcaatgctgacttcgctttggcataaatcgtcgtcataatcccacgcgttactggaatcaaagtggtagtaaattcaatcgcagaaatcgcggaccaccactgctgtaactgttgcatcatttcagggatatgttgatgttgattcaacttatataaactcaaattatcattcacagcgacgtaatgactcgcagctgtcgctcgtttgccagcaccagataagccggacttagcatccacaacaatcgaagtcggttcgaccaactgctgctgagcaagtggcgctagtcctaataacgtagcagtcgcataacagccgggattcgcaatgtaggtggacaacggcgccggcatatcagctaagccgtagctcgcctgtgccaaagcggtcgccggtgctggatcacgttggtaccaccgctgatattgctctggatcatgcaagcggaagtcaccagataaatcgatgactggaaaatgagcagcgatgaatggtaatgccaattgtcgcgtgatgcccgctgatgtcgcaaagaacacaatcgcgttatcgcgcatgattgccgtcgcatcgaatggtcgaataaccgccgtttctttctggtacatggctgccaccgtctttaatgccaccgtagttgctcccacgtgcccgtataattggatgcggtcgatctcgggatgttgtttcaaaagccggtacaacaccatgccactgtaccccgtaacgccaactagcgcgacttgcatataatcacctcaaatattcaaaaatagtgtattagctgcatattcatgcaaaaagtatgattcacactatattctcatcgctcttaaattgcaagctttattgaaaaaatattcacttttattctattaattgcatatttttagctttattcagtcatttatgcacttaatatgtatttttaattgacatccacgataaaatgctgtttacttatctcattagccaaaatgaaattttaaccaaattatcagaaagggtgcgattgggatgaacaaatacttaactttagcagacggcacacagtggattggaacggcaattggggattgccagctagaggctgcggggcgcatcgtcttcaatacgggaatgacgggttatcaggaaacattgactgatccatcctacctaaatcaaatgattgccttcacttacccattaattggtaattatggtatcgatccgaccgtggcccaggcaccaacgattggcgcacaagccatcatcgttcacgagctggccacttttaatgatcactatactagtcgccaatcactggcaaattttctgacaatccaccatgtagccggcattgaaggcgtcgatactcgtgacctaacgattcacattcgccaaacgggagcccagatggcaatcttgagcaatcatcccatcactgattttgaagcgcaactcgccacattcgcaccccaagtactaacggctacccccctcccagtagcgacgaccaccatccgtccacgcgtcgcgattctcaactttggtgaaaaagcagctatcaccgctgaattgcaagcccggggcgcggacgttgttgtccttccacctacagctagtctcaaggccgtggccgcgtatcaccctgacggaattttgttatccaacggtcccggtgatccgaccgactatcacacttacttagcgaccattcgccaactcgcacaacgttatccgctggctggcatttgccttggtcatcagttgattgcgctcgcctatggtgctcagacttaccagctttcctttggtcaccacgggctaaaccatccggtacaagcctgcgctgacggtcgtattatcatgacttcgcaaaatcatgattacgccgtcgatccggcatcgatcaagggcaccccgctgatcgtcacgcacactgaattaaatgacggcagcattgaaggcttgcgcctaccgcaccaggccgtaatgtcggtgcaattccatcccgaagcacacccggggccccaggaagctgggcaatttttcgatgatttcttactaacaattcaaaaggaggcggttgttaatgcctaaaaacaatgccattcattcgattgctgtcatcggttctggtccaatcaaaatcggtcaagccgctgagttcgactatgccggtactcaggcttgtctaagccttaaagcggccggctatcatgtcattttgatcaattcaaacccagcaaccatcatgactgacacggccaccgccgacgaagtctacttagaacctctgactttgaccagtgtcactaaaattctgcgggccacccaccctgatgctttgctcccgacacttggtggacaaaccggattgaacctagcgatggcgttagatcaggctggcgttcttaatgagttgaagatccaactgctaggaacttccctagccaccatcaatcaagctgaagaccgggcagcatttaaaacacttatgaagcggctccatcaaccgattccagcaagtaccactgttcaccacgtgaccagtgcattgtcgtttgctgaaaaaatcggttatccggtcattgttcgtccagcctttacactcgggggttcaggtggcggcattgccaataatgccgccgaattgacccaaacgttacagcgggggttgaccatgtcccccgtcaccgagtgcttgattgaacaaagtatcgccggcttcaaagaaattgaattcgaagtcatgcgtgataatcagggtaccaagatcatcgtctgttccatggaaaacttcgatccggtcggtattcacactggcgattctatcgtgtatgcccccgttcagactttgactgacactgaatatcagcagctacgaacggcggctttgacgattgtggaagccctcgacattagaggtgggtgcaacgttcaactcgctcaagacccgaatagtcgtcagtactacgtcatcgaagtgaacccacgggtcagtcgttcatcggcgctagcttctaaagcgacgggatatccaattgccaaaattgcagccgatatcgcaattggtctaaatttatctgagatcaagaatccagtcacgcagacaacctatgcggcctttgaaccagctttagactatgtggttgccaaaatcccccggtttgcgtttgacaagtttccaacggccgacgctcacttgggaacacagatgaaagccacgggggaagtcatggcgattgggtcaaccttggaggaagccacgctcaaggcgattgcttcgcttgaaatcgatcccaagatccaagcttccttgacccctgaccaccacgtcaccacgactgaatatatcgaccaattgacccacccgacagatcagcggctcttctatctattggcggcgctgcaagcgggttggccgttagcaaaattagcgacgctaacgcaaatcacgccatttttcttgagtaagttacagcacatcgcccaactcatccggaatatcaagcaagtgccgacgtcccaacacctcttatcggcgaaaaagtacggtgtgagtctggcgaccatggcgcattatgcccaaacttcggtagcgaccattgctgccatgactgctgatttacccttcgtttataaaatggtcgatacgtgtgctggtgaatttgccagtgttacaccatatttttacagcactgcttttggacaaactaacgagagtcacccactaggacacagtattttagtactcggatcaggccccattcgaatcggacaaggcatcgaattcgactacaccaccgttcactgtgtcaaggccattcaacaagctggctaccatgcaatcatcgtcaataacaatcccgagacggtctccaccgacttttctacctcggataagctttatttcgagccactaacaatcgaacgtttgatgccaatcattgcgttggagcaacccgcgggcgtcatcgttcaatttgggggccaaactgcgatcaaccttgcccatcagctcactaaattaggagtcaccgtcctaggaaccagtgtgtccgctaccgatttgaccgaagaccggcaatcttttgcggactgtttacgtctactaaagattgcccaagccgctggaacgaccgtaactgagttatccggtgcccgtcaagcagctcacgcaatcggttaccccttactcgtacggccaagctttgtactcggcggccgggccatggcaatcgttcataacgatcatgagctcacgccagttattaaatcagcggtggcagctggccatggtgcgcctatcttaatggaccaatacttggcgggaaccgagtgtgaagttgacgttctctccgacggaacatcgtgcttcattccaggaatcatggaacatattgaaggtgctggcgttcattctggcgattccattacagtctatccaccacagcacctcagccctgctgttcaagataagatcgtcaccattgccaccaaattagcacaacacctccactgtgtcggtatgatgaacattcagttcgtcgtcaccgatgatgtctacgtaatcgacgttaatccgcgggcaagtcgaacagttccttacatgagcaaggttactcacttgccactggcacaattggcaacccggctaattctcggtcaaagtttagcaacccttggcctagtccccggactcttgacacccgctccacaacaaattgctataaaggccccagtcttctctttcaataaattgccacaatcaccagtcgttttaagtcctgagatgaaatcaactggtgagactcttggtatcggcccgactttcacgaccgcttggcatgccgccatggctgatagttatcacttagagacttggcaaaccgtggatggtctcatcaccgatattgccactgtggcgcaacccgcggtccaggaactgttcgcggctaaccacctcaccgtcacaacaatcgctaacacgactgattggcctgcaaagactaaagcagtgggtttcacgcttaatgaccaacctgataatcccgtggctatcgctgcattgaatcatggacaaccattgattacggcgattgataccttaaaaacattattagcagtaacaccaaccccagctaccatctaacttgtttggcagcactaaaataaagcacctatcaattttcgataggtgctttattttggccttagccatttcatttgagcgaaatctccaaatactgataatgtcgttaacgttgtctttcagtgatcggcaacgccgggatctcgttgaatagaattggaacggtttcaagagtcacctcggagaattctaggccgaaccatttggcaggcgttgtcgcgtattttttaatcattaatttcgtctcgatcactaatcgatccaagcgggataaccgactaccattttctaacttctcctcgatgataacgaagcggaagtcaccgacatcgcggccagaagtgactgaatatgtctgcttttgcgccgctaaacgtccagtagccattaagtcgcggacaatcgtccgtaaatagcggttaatatcttggcggacacgaaagcccaggtataacttaacagttaccaaatagtccgttgctaacgtgtcgacagtatactccgcggtatacggttcatccgtgattgtcacattaacaaaccagtagacgtcggcacgtttcggccacttgtctaaaatcgaatataatacctttcgctccacttggtcgccatccattcggcttgttaggaagaccacgttcgtctggaacttgtccaccgtctgatcgttacgtaacttagcaagctggtcctgatattgtcgtaaactaagcgggtggttatgttgtctgacaatttgttcgccacgataccacacagccatcactaggaaaattagtaaagcaagtccgaccgctacgtagccgccgtgccagaacttggctgcgctggcaatcaggaaaattacttcgatggtcgcgaagaaaccggtcagtagtcccgcaccgattaatggtaagcgcttttgccgtaaaaacgcgtagatcaaagtggtcgtcatcagcattgtcagtgtgatggctaacccgtatgcagcttccattctttcactagtttgaaagaaaatcaccagcatactcgtcacgccccacagcccccagttaacgaccggtaaatacatttggcccactgctttaccggggtaagtagttagtaatcgggggaatagtttcagtcgaatcgcttcactaactaacgtaaacgacccactgatcagcgactgtgacgcgataatggccgcgagcgtcgcaaaaatcactgccgccatcgtcaggctagcaggtaacattgcaaaaaagggattcacatggccctgaatcgcttggccgggacctaaaatccatgcggcctgaccgaaatagctgagtagtaggcaagctttgacatacggccagctcaaccgaatattcgttttgccgacgtgccccaggtcactgtatagggcctcagcaccggtcgttgccagaaagacgctccctagaatcaaaattcccactttgttcgccgggctgatcaagagtaaccacgcataatagggattcagtgcacgtaggatcgtccaatcctgcaccagattaacgaagccactgactcccaaaaacgtgaaccagcccaacatgatggggccaaataacttgccaatcgtgttcgttccaaaacgttgcagcataaataatagggtgataattccaagtgtaatcagtataatcgtattttggctggcaccaaacagttgaacgtatgctggtacatcgcgtaagccttcgatggcagtcgtaactgtcactgcgggagttagcgccccatccgccagtaacgcagccccaccaatcatggccggaatgactaaccagcgagcacgatgacgcaccaatgcgaataatgaaaagataccgccttcgccacgattatccgcgtttaacgcaatcagaacgtacttaacggtcgtgagcaacgtcattgtccaaaaaactagcgagacggcccccaacataaacttctcatcaacggcctgcatcccaccttgaccggtaatgatggccttcatcacgtataacggactggttccaatatcaccatatacaacgcccatcgcgactaacaatcctgccacccgatgcttattgaactgagcctgtttactcattatgcccccatcctttcaccgatattcacgagttacagccaatcgtccctcgttataatggattcaactagcttacctaatcgtcatcagaaagacaatcataatgcacaataacgttagctcatcactaaatgctccaacaggccctgtaacatttaccggtagccaatttagaaactaaaagcgggtttcaatccagtcattaactgaattgaaacccgctgattatccatactcggtcatcgcaccgaaatagttcaattatgtaaataattaatccccatcgattgactatgattgaaacgtgcgttgtgtccgacgtcgtgttcgatcagctaacccaatactaatctgtaacgcattatcaactcggcgcatcgtctgatcatccaaatgagtgacgcgatctttaagccgttgcttatcaatcgttcgtatctgctccaacaacacaaccgaatttttttcaatccccgtatgggcagcgttgatgttaacatgtgttggcatcttcgctttttgaaccttagcagtgattgccgcgacaatcactgtgggactgtaatggttaccgacattattttgcacgattagtactggacgcatgcctccttgttcggagcctacgactggtgataaatctgcataaaagatgtcaccacgcttaatgtcagctgcggccatcgcctcatctccctttattcgatacccaatgtatctgatagtaccccaatataaccatcttgctactcataatagcatgaaccattcacttttagcaaccgtttaccaatttaatccaaagaactaatcgctaagcaccgttaaaactaatacttcagaccgattaattaagactgcccagtgatgatttcatcaatgtttaaaaataaacgaacttataattagatgccgataaatcaatcgaatcactgaaataaacttaacagccctcatcaataaaataggagactctaaaaaatgagcgccagaatttctccggcactcattttattggcttaatctcaataaccaaccatgtaaccatagcctgtacgagacagtcggcgcaaacctatcgtctgataaaacttaatctatataaactctcggcactcgtggtgctaacccacaagcaatctcataatgaattgtcccacaatagtcagcaatatcttgcaacgaaatggtacgagcaccgtccgtgccaaccaaagttaccttagctccaaccggtacttcatgtggcagacgaaccatcagctggtccatgcagacccgtccgacgatttcgcaaaactcaccatcaacaagtacatggaagccttgtaatcggcgttcatagccgtccgcatacccaatcggcaccgtgccaatccattcatcctgtgcggccgtatacgtggcaccatagctgaccgatttgccccgagccaagcgtttaacaaacgtcaagcgtgccgttagcgacaacgcgggttgcaaggggtatggtgcgctgagttcgcgaccagaaggatttagaccatagagtgcaaccccaaagcgcaccatgttgccattgcaagcttgatgccagagactggtggccgaattggacacgtggacatagcgtggtagctcatccaccactgcaatcaagtgtttccaattatttaattggtgggtaaaatacgtatcatctgcttggtcagccgttgcaaaatgcgtaaaaatcccttcaaagtcaaatggtgactgcggttgacgcaaagtcgtaaccaccgttgccaattcttcgggcgtctgaaacccgattcgtcccatacccgtatctaatgcaagatgaacgtgaagtggtgtcgtcacttgattagccgctaaaattgctgcggccgtagtcagccaatcttgcgttccaacagctagtgaaatatccttttcagctaccagtggggcgtattccggttccgtaattccaagtactaggatgggttccgcaaagccagcggcccgcaacgctaaggcctcatccaggattgcaacacaaaagccggtcgccccggcttctttggcggcctgagcaacttggataattccatgtccataaccattcgctttaacgactgcccataactcggtcaactcatccttttgcgccatttcattactaatatttgtcttaattgcctgcaagtcgactgtgacttgtgtgtggcggtgctccccaattacaaccatcacaaattgcctctttccaatataacttgtgtcattactaacgtatccgtgtgtgaaattgaaatccacgctggaccatcaaacgggtggcgcgtaacttccggtttaccctgggcgttgtctaaaatttcgatatcttgaaatccaactgccgcaccaattcccgtgccatatgccttactatatgcttccttagctgaaaaacgccctgccataaactcgatctggcgtttaaccgggtaacgtgaaaacaccgccaactcagccggtgttaagatcttttcaggcaatctcagtcccttcgctagaatcgcttcaatccgactaagctcagttaaatcaatgccggtaccataaatcacgctgtgaccccctctatctcattattatcacgtcaacttaggctgatgtttccaatttaccacagctaccgccgcgataaaagggcccatacacgcaatcttttcatgtcagcatgaattattgttaaaacgttccaaacgcgtcaagtcaaagtcggccagcttagaccgctggaaaaaagtcgagtgagcgtaaatatgtttggttagtgcatcctaacaccgacctccaggcatttcgggacagtgttcgaatggcggacatgtgtgtacccaacttttagtaaattcgtcattgtttttcataaaccataattttgtcaatcaactgtcagacagaaaatgacattgtgatagctcactattcccgaatcactataataatcgaacgtctcaacaaggcggttaatgtcaccctaacgtttcgtttaaggttccggtgtcaaaatagtcagcgaccaattgtgccgagttaagtggccgttcatctgccattcgagcgggttcctgaaacgtattcggtaccgctaaagcctgtgcttgctacgccaacggactaatgtcaaaaccgcattaatccgttggctaggcaatgctcggcttcaacccgtggcctctcacaggcttgagactggaggggctgggtgacaatgctcagtagccaagttattcttaggcggaagtgggttgcttccggcttagaataagactcgtatttgagatgacgcgggttgggcgttagctcaaatcgacgtcggctgcgttccagcaattggcacccagccccggaggtcggaataagacgtgcaagtgctgacgaacaacaaaccaattaaattggaacgttttaacaataattcatacgaacatctgccgactacttgtattctaacattgtagggcataaaaaaagccgagcatgcgctcggcttttgtgcaaagttaatttaattcaacttaatttgtgcgttgactttaatcattggtgcggatcgtatagctccgcttgctgctttgcttgcgaccttcatcatggttgcggttgctgctccggttatcatcgcgactgcgacctttataaccattgctcttccgatcgccacggccaccgttacgatcacggtcgcgattgcgaccattgtgagaataaccgccacgaccattgccatgactgttattgcggttgcgattaccgccacgatatccgccacgccggttgttaccgccgccacctttgtgacgaggtaatgggcgttctggcgtaatcttaacgggtacggctgaggcgtcgtccttagttaagtcatttaacaaggcagcaactagatcagtagcatcgtatttttgtaataattcagcagcttgatcagcatacttttcagtcgaagtcttagcaactaacgaatcaacattcgcttctgcagcagctaattggccagcaaaagcttcagattcagttggtggcttcaatggtaacatccgcttcttggtcaacttttcgatgacccgcaaatattccatttcgtttggtgttacaaaagttaatgaaacacccttgtgtccggcacggccagtacgtccaatccggtgaacataactgtccggatcctgtggaatatcgtaattgtaaacgtgggtcacaccagaaacatcaagtccccgagcagccacatcggttgcaaccaaaatatccaatttaccagccttgaattgacgcatgatttgcgtccgacgttgttggctcaaatcaccatgaatcccagcggcattataaccacgtgcttcgagaccctttgataattcgtcaactcgacgtttcgttcgaccaaacacgattgtgagttcaggtgcctgaacatcaaacaaccgggtcataatatcaaacttttcaaattctttggctttaacgtaatattgatcgaccgtatcagcagtcatttcttttgatttgatcttaacgtgatgcggttccttcatgaactgcacaccaatgcgtttgatttcaggtggcatcgttgcggagaacaacatagtttggcgttcatccggcacttgtttgataattgattcgatatcttccaagaaacccatgtttaacatttcgtcagcttcatcaagaactaacatcttgacgtggtctaacttgaccgtgccccggcgaatgtggtcaagcaaccgaccgggagttccgacgattacttgtgggttttgcttcagatttctgatttggcgccgaatatcagcaccaccataaacgacttggactttcgcccgttcgtctttacctaagcggaagatttcttcctgagtttggattgctaattcacgcgttggtgaaacaactaatgcttgaatgttatggttatcaaaatccaagcgttgtaagattggtaatgcaaacgcggcggtcttcccagtaccggtttgtgcttgaccaatcacatctttgccttctagaaccattggaatggtttcggcttgaatcggggtcgcttcttcgtatccggcccgattaactgctttaagtaggctatcggataagcctagttctgtaaacttcaaatatgtttcctcctaaggatgacaccatgggattactgccagctaggaaaaaatccgtttcccgtaagacgctgtcatgtaagccaacggtctgactttcatatggtacaactgaattatcatacaccggttattctaaataagcaagcaaagcccctagcaataccggaagggaaataacattatcagtctaatgttagcgtcaccattacccagtcattgcgaggggcctgcttaatcgaatcacttaaattttatttttcaggagcagcttccagcgccgtcagaaccttttcaaggtgaatcccgtgactccccttcaataagacctgatcatccgcactaaccgttgccgttaagtcggcaatcaattggggttgttgatccgtttgataatagtggaccgcactggctgggtacttttcttgtagcacttctgccaacgctcgcatatgttcaccattcaaatagacgctggcaatcgtggctggatccaattcactggctaaactcatgtgtagtgcatccgactggtcacccaactcaagcatatcaccgagtacagcgattcgctgacccttagtaggtaccgccgcaaaagcggctaggacccgtcgagctgccgttggattagagttataaacatcacttaagatggcttctccacggtaaccagttaaccattccgtccggttctccgtcggcacaaaactggcgattgcttgttgcgcagcggctggtcgaatgtgaaaagtatcagctaccaagagtgccgccaatgcattattgacattgtacgcacccatcatcggaattgtgtacgtgttgtccggccacagactcgtcttaaattgcgtttgagcccgactagtcgtgatatcactgcctgctaaggtgttcgtatcatccaacccaaacgtccgttgatgctgactgacttccttagcacgttcttgtaacagtggttcatcaccattaaaaatgaacgtgccatcttcttttaagccgtggacaatttccattttggcatcggcaattcgatcccgtgtaccaaagaactcaatgtgggcttccccaatcatggtaatcaccgcaacgtccggctgaacgagacggctcaagaaatccaactcgccaaaatggtccatccccatttcaacgacgaccacttctgtattcggttccatacttagtaacgtcactggcacaccaatctgattgttaaagttggcgtgcgtctttgtcacgttaaactgagtgctcaaaacactcgcaatcatatccttcgtcgttgttttaccattactacccgtaacagccacgactttcggattaattttttgtaaatagtattgccccagctgctgtagtgccgtcaatgtatcagcaaccataatgacaggtaagtcttctggaacgtcgtcggcatggtcgctggcccataaggtagcaacggccccgtgctcgattgcactttgaatatattgatgaccatcattagcgcccatcagcggaataaatagatcccctgcttggagctttcggctatcaaacgccacacccgttacattaacatcgggccacgcctgttcggcattgaccgcttgaacggccttagcaatttcggcaacttgcatcttcatatcgattaaactctccattcatggcgaccacttgtcggtcagccaagttctgactaaggttccactttctcgaatcgtagcccaattcaagctacgcgcataaaaattataccactttgaccccagggactctatggctagaccaatttagcccctaaatcccgccccaaacgacttaaaaacgcccgctgaatgatcagccaagcgttaagatgataatactataaatgttcttcgaacgcagcctggtcctgcacttgcaagtcccacacgcctgaattcaagttaaaagtaagggtcgcgacatggtgggttcgccgattctctccaccacgagcgggatcaaaaacttcgatttcattgcctgtcgtctccgtgtgcaccggcaccaataattggcgttgccgaaccattgactgatcaaagtaaatgaacaaaccatctggcatcaattgaacgagttgcttgagaatcgcttcaggtactcgtggaacactcagtgaacgcataaacatacgccggccacggtaagctgccaaagtgtgccgcacaatggcagcacttaaaatatggctaaatgcggaaatataatagaagtacactttgataccaccattgcgttgttccaagaaaacgtagtggttgcgcagtttgtaattaaacggtgatcgaattggacgatccatatgtccgagatacaatagctcggcaatctcagtcgcagttagaaaatccaaatcgccaacctcatcataatcaagccacttaacgggtaacgcgtgactctgtaacaaatatcgccgaatttcattttcatcattaatgacgttcagacccgtgtgagcatttaccgcatgctcgttatcatcaacaccgactaacgagaccaagttagctggcaagcgcttgataccatgcacaaagtcgctctggtcgatcccgtaagcaaagacaaggttatccagtttttccaaattggcgtaaatatatttgcgttgcaaccgtctcactctttcaactttctatttgttttcattataatccgttattaacctaaacgcatttttttattacatgttttttaaacgagtgatgcgatcagccatcggtgggtgggtatcgaataagtgcatccatgatttcttcgccttaaacggatcagaaatataaagggccgcgctactaggatccgccgcttgcatgggttggctgtcatcgattttttcaagtgcactgattaagcccaacggattacgagtcagttccacactgccggcatccgctaagtattcgcgattacgggatagcgccatctgcactaaactagctgctagcggcgctaaaataatgacaacaatcgctaggatcattagtaagacctgggcaccgttgccgtcacgatcattatcccgactgcgccggccaccgccccaccaaaaggcgttcataccccaattgactaacaaactgatggccgctgtcagagccaaggcaatggtctgtaaccgaatatcatagttacgcacatgactcatctcgtgaccaatgacgccttccatctcttcacgcgttaatcgtgcctgaataccagttgtcactgcaactgccgcatgctcagggtcatttcctgtcgcaaacgcattggggctctcatcatcaataataaagacacgtggcatcggtactttagcaaccaacgccatgtcttccacaatgtgccagagctctggatcatcgtcagcttgatgcagctcacgtccatgattcatgctcatgacaatgtcagtcgactgactaatcattaataccatataaaataccgctgcaatcaaggctactagtaaccctgcaatcgcactattaaaaaacacgtagccaactgctaaaccaatcactgcaagtaatatgacaaaagcggccatcacgtataacgtgtgccgcttgttgcgggcaatttgctcaaataacatgggcataacctctaatcttcaaatgaaaccgtgggtgccgctttttctgcttcaggaacagttaagaattcaacgttcttgaagtgatgaatgccagcaataatatttgacgggaattgttgtaacttcatgttatagctggcagcgctagagttgaacagttgccgtgaataagcaatcttgttttctgtattggtcaactcttccatcagcttaccgaattcttgattagccttcaaatcagggtagctttcagctaacgcaaaaatgctcttcaacgaatttgtcaattgatcagaaactgccatagcctgttggtgatcaccgctcggcacttgcgttaattgattccgtaatgaaatcacttccgctaaggtactcttttcatgtttcgcgtaacctttgaccgtattgaccagattaggaatcaaatcagtccgccgttttagctgaacatcgatttggctccacgcttcctgcgtatacatccgtgacttaactaaaccgttataaattaccacgtaaattgcgatcaaaaccaatacgaccgcaacgataattaaagctatcatcaatagaccccctctaaattatgtcttatctgagacatgtgaccttaagttatattgtaccgtgaaattccgttagaagatatcgatacccctagaatgtaataattgttaatatttgttattaaaatgacttgtaaaggccttctgaacctgagttggcgccgacttaaacgaccattgctgttcgtacttaccgcgaatcattaagcgacccgccccggtcttatcacaggtaattagggtaatcagcttctgaccaggaacatcatcaattacttggacatcagttgctttaatgaatgttcgctgactcgtcttatacgcataaatctttttggcatcactcacataaatcatttggccaaccttgctcttatagtacaacggactgaatagtgcgccatgcttgatcatatggtgaccagccaacgcgtagttaccctgccccatcttctgattagctttcatcgtgccagccgccaatgctaacgtttcattgctgacaccattaccgattggcaggtacaaatcaacggacggaatcgcaatcgagccaatcacgttgattgcattcttattcatgcgggccttggcaacggtctgaaagtcaagtgacttgacctttgagaagttaaaatcgctcttcttcttcgtattctgcttaaccgtcttagccgtaacggtcggcgagtatgaactcactaaccagctcttgatctgttcattgaaaattaatgccaatgatactagcaccagcaggacaaaaacgccccgacctaaccactttaacccgggatgttgcttggacttcattaatcccgcctcctaatttgtttacgccctttatcaaaggttctacggtaaatataccttaattagttcgcataataaagccccgaattcgtttagttcgttagaattatctatagcttatcataatcattatatttgcgtccgtaatcagattcttgttatgctaattgtatcaaaaacagaaagcaggttggacctatggaaacgatggtaaaaaacgatctcaatcaactaatgcaacaacgtgaggatggcccatacattgcaatttacctcaacacggccgttgtgctcaacgacctcaatcgccgccgcttacaattcaaacaattagttaatgaagctgaaacccagatggcccaccactttccgaaaaccgaatttgcgccatacgcgacgcaactagagcaattaattaatgacaacgccttctggttacagcacactggccctcagacaggcatcatcactaacagtcgtgacctacacattttcgacttacaatatcccactgacaaccatgtcagcgtcaatagcatgccagctattcgcccagtactagccgaccgccagcatcaattcgacttcgacttgctagcactcaatgaagatagcatagcgctctacgcccaacgtgatggcagtttcgtcgaacttgatttgccagctgaggccccccgcaccctgacagaagcattgggcactgaaaaacgtggcggtgacctgaatttcaacgccagccccgttcacggtgccaactatcatggtcataatgcgaaggccgaagaacgcgatattgaccaacgaaattattaccaacaagtggcgcagtacgttcaggcccattcacaaaagacgcgacggccattgatcttaatgggactaccacataaccaggcagtcttccgtgccgtcaacaagaatccgtacttgtcacaacacctcatgatcaataagtcaccgaaaaacttaacggtgggcgcaatgcaaacagccacagaacccgttcagacgatgtggcatacccaattagccgacattttactagaacgttatgatcaggctaagtcccgccagttagcattggccgatccttttgacatgatcaagccagcactaagtgggcggatcgacaccttgattgtcgccgcagacgcgaatgttgccggctccttaccagcggccgatgttcaattaaatgatccaattgctgctcctgataatttaattgacgacctggtcgatgtcgtgattgccatgaacgggcaaatccgaatcatccccgcagaccggatgcccgtagaaaccgctgctctcgcgattatgcgctactaatcatatcgtaagtgagacaaagccgcaccagttcattactcgaactggtgcggctttgtttgtgagcgtcgatgatttgcacatacaaaaaagacgcccccgccgaagccggaacgccgtttaattgtctgcttatttgagaccgtatttcttgttgaaacgatcgaccgcaccatcggccttggtaaacttttgcttaccagtgtagaatggatgtgaatctgacgtaatttcaacacggatcaatgggtaagtattaccatcttcccattcaacagtttctgctgaagttgctgttgaaccagagatgaacttaaaaccagtagttgagtcttggaacacaactaaatggtaatctggatgaattcctttttgcattgtatttcgctcctttgccctgaatcatttgctgaaacagagattatcatagttttaaccaacgataaacatgttatcacgaatcacagcttcccgtcaacctacaaagtagcctgcctgccagtattaacgacgcgaccgccgggttgattgaccagtgaactttaagctagctaaatcacgaacaaactcagtgttggtcttcgtgtgttttaaaaattgtaaaagctgttcggtatactctaacgcgttgccagtcattgatcgacgaatctgccagactggctccaaattcttacgactaaccaacaattcctctttacgcgtactggattgcttcaagtctagcgccgggaagacccgccgctcagctaactcgcgggatagctgcaattctgagttgccagttcctttgaattcttcataaatcatgtcgtccatccggctacccgtatcgactaacgcggtgcctaaaatcgttaggctaccaccttcctcgatattgcgcgcggaaccgaagaatcgcttgggcttgtaaaacgccgtgggatcgaccccaccagacaacgtccgcccgctagacgggatgaccaaattatatgcccgcgtaagccgggtaatcgaatccaataagataatcacatcctgtttgtcttcaactaggcgccgcgcacgttcaagcaccaattccgcaacacgcacgtgattttgtggttgttgatcaaaagtagaactcaccacttctcccttgattgaccgctctaaatcagtcacttcttcgggccgttcatcaatcagtaacataatcagcttagcgtctggataattggcgacgatgccatttgcaatattctttaacagcgtcgtcttaccggctttaggaggtgcgacaattaagccccgttgaccgaagccaatcgggacaaaagtatcaatcaaacgggtcgctaaaacggcggccgttgtcgataacttaatttgtttttgtggataaagtggtgttaacgctggaaaatggggccgttgcttggcctcattaggatccttaccgttaaccgtccctacccgcattaaaccgtaataccgttcgttaggtcgcggtggccgggcttgaccagccacatagtctccgttacgaagaccaaagcgatgaatctgcgactgagaaatataaatatcttcctgcgaaggcccataattaattggccgcaaaaagccatagccctcttggctaataatttccaagacgccttccatttgtacaaagccccgctttttatcctgctcacggagaacggctaatgagagttcctttttattcatttgcgaataataagaaattttatactcacgagcatagttataaatttcttttaacgttttctgctcgagatcgtgcattgttaaaattttttccataaccactgttctttcttagctgtacatcgttagttttcgggaaattcttcgtcggctgcaatttccacatccgcaccaagtgtatgcaatttatcgatgacccgatcatagccacgtagaatattgtcagcgcgactaatttccgtaacgccactagccgcgagaccagcaatcattagtgccgccccagaccgaatctcaccggcctcgacatgtgcaccttgtaagtgggaagaatgacccacgacaatcaagttatcttgaacgcgaatgtccgctcccatcttacgtaactgttcaacgtgttgcgtgcgttgcggataaatcgtatcaatcaccacgctactaccgttagcacgcaataataatggggtgattggttgttgcaaatcagtggcaaagcctgggtaagtcattgttttaacccgaattgggtccaaatcattggaccgtgggacgtaaatactatcttcattaatctgtaaatcgacacccatttcgactagttttgccgtgaatgactccatatgttcagggatcacattctttagcaaaataccgtccccaatcgaagcagccagggatagatacgttcccgtctcaatccgatcaggaataatcgtatgggttgcccgcgaatgcagtgccggaacgccttcgattcgaatcacgtcggtaccagcaccccgaattttagcgcccatattattcaaaaaagtcgctaaatcaatgatttcaggctctttagccgcattttcaatcgtggtcgtaccatgagctttgacggcagccaaaataatgttgatcgtcgccccaacggaaaccacgtctaaaaagatgcgcgctccgtgaaggccctctgtgcccgttgagataaagacagagtcattctcttcaacgacgttagcgccgagcgccttaaaacccttgatatgctgatcaattggtcgtggaccaatattatcaccaccagggaaagtcaccgttgcacggttaaaacgaccgagtaaggcccccataaagtagtaagaagctcgcaagcttttaatggcatgacttggtaattcagattcttcaatatttgttggatcaattgttagaacatcattttcaaaagtggaatggacgttcatcgactctaagatgagccgtaagttgtgaacgtctaagatgtgcggaaccgtatcgaattggaccggagtgtctgcaagaatcgcagcaggaatcagtgcgacggtactattttttgcgccaccgatcgttaattccccagaaagtcgttttccgccatggattatcatttttttcataacataactttcctcgctaaataagtgtcacactgtatcatacaatcattaaccataataaagaatgtccgtcaaaaatacaaccaatatcaggaaactgtaatctttttacgcaataaaatcatcaactcgactaattcaaacgctttcatgaatgatttggtaagataattaagctaaatctgcacaatttaaggtgccgtcaaagtcgccgatatcacacagcttattctgatatcaacagttaacatggtcacatgattattgtcactattcctcactaattttgctgctgtcatactatgtaccccatacgatgattgggagcgcgatgatgccgaataataattcaattaaacgttccactttaatcatgccccgcccagaacgactattagcacaatgcccgatagaaaaatagaaaagtgctaatgcgcgtgataaatttcactggcattagcactctctggactgaattgaacctgatggactatcagtattcatgactaatcacttccttatttaattaataaccttccgttacccgttaatcgcaagtagctgttccatatgttggggtttcatattaagttcacgcaactgcaataacgtctgctttaagttttcatactcggcttccgtgtataaacggctctcaaagccaatctgataagcttcggcaattgtaaccaaatcgcgtcgtaaccggcgtcgaatttcgttcggtgtcaacattggcatcacctccatttattattcaccataataccatataatgcgccaatcaacggtccatgatacgatttgataatctttgataattgataataatcgcaattgacccccgctacatcagcctttcaactcgctgtcagctaatgaaaattgcatgagatttattatgatgataatcagttgataaccaaattaataaaatctttaatcccccttttgataagacctagaaaattcccactgacatcctcaaagatgtcattctaaccaaattatcataaaaaggggctacgttccaacctgaatcacataaaaacacacgctcccctggcactaatcgccacaccaattgcgaccagccaccactgaacaacgggggatttgattgctcagtttatttaactacttaaaatgcggcagcccgcacacaaactggttgtgttggctgccgcatttttacggtggtgaccatgattcttacctgtccaggaactcagagtagcttcctcacagtttcgccactatggctgaactaaattttgacagggtttcatgacgttaatcgcttacaattacatcgtttaatcctgctggagatcctcatctttgacggtctgcaaataacgataaacactcggatcagagactttgagcactttggcggcttcactaactgaatccttcaataggaagtaaccttggtggtataagctacgaacgatttctaatttttcattttgctttaaatattcaacagaaacgccatacttagcacagacagcctgggtcacttcccgagctaaatcagtgatagaagtggttagatgttccggcgcgaccggcgtgtcatgggccttctcgttagctggtgttcctttgagttgattaatcgttggtgagttcaaatgtttgtaactcgccattaccttcaatacttgttcctgcagatcgtctagggcactatcatccgtattaatacaaatcatcccgacgatttcaccatctaatcgcaaaaaataagttgatgatcgtagtgagtgctttccttgcgaaacacccttgtagttggctagataatcacgcttttcagctttaccggccttcatcgttcgcaacgctaagtcagttgcaggatcgccaacttgtcgatgtgatatgtgggaattacgaattgccacaacggagtggtttaaatccaacaagtcgttcaggacaacttcactactggggcctaagatatctgctaaaaaatcaacaaacggaataaactcgcgcacgtattcttgctcagctgttaatggtttttgcataacggcactcacctcactatttttttacaacgttatgacttaatattattttatcacactgataaaatgttaatacatgtaacgatataaacatctaattaaaaaagatgataccgcctttagtcagctcatcatctttctgcgacatttttatgcatgaacttgtgaattagtcgatcgtccaaaaatcttttccttcatccgaataccggttggcgtcgccgctaagccacccagtccagtttcccgaagtgcctttggcaagcccttaccgactttatccatcgctgcaatgacttcatccgctggaatcttgttcgtgcagccagccaaagccatgtcagccgcaatcaacgcattaccgaccccaatcgcattccgtttaacacacggtagttcaactaacccagcaacgggatcacacactaatcccatcaagttactgattgccatcgccaaagcctcagcactttgttcaggcgtcccaccagcaacttcaaccgcggccgcagcgcccatcgcagaagcgctaccaacttcagcttggcaaccgccagtcgcaccagcaatcccagcattattagctatgaccatcccaaaagcgccagcggtaaatagaaattggatcatctggtcacggttgaggttcattcggtccttcagcgtgaaaatcacaccaggtagtgtccccgtcgatccagccgttggtgtcgcacaaacgactcccatcgaagcattaacttcattggttgagattgcgttctgaacagcttgcatcatcgtatcgccggataaagtgtgccctttttgacgatactttttcaagagaacagcttcaccaccagttaaaccagttgttgaatagaccccgtcgcctgcagcccctttattaacagctgcttccatgacgtctagattccggcccatcgtgtgccagatttcttcgcgactcgtttgcgatgtttccatctcttgttcaatcattaattcgtagatcggcttcttggtctccttggccgctgttaccagttctgctacgctcatgtacatcataactgacctccctgattataagtaaactaaatttgcgtgtccctgcgctaattttttgatttcatcctgtttgaggcggcgatccaaatcatattcatataaattgccccaagccgtcttgtactgctgctggtcgtttactttagtcagatcagccaactgtttggtcacgtgctgatggtcattctcaccaccttgaactaacaagataggaagtggccctttgggtttaacatcaaaaccatccatcttgatttcacgaatttcgatggttccacccccgattgaacatccagcgaccgtcacttgcttatcatcattttttaagtcaatgatggcagtgttcgggtggttgattgggctatcaccaggctcttcgataaaggtaatatttatcccctgatctcgggccaaaccaatggcatatggaacccggctatcatcaggatcaaaaccaagaatgccactgataatcgcatagtccgttccgtggcccttgtgggtttgcgcaaatgattcatagtaatgaatgacaatatctgtcggtttctcctgaaaaatgctattcgctgctcgaccaatcgcacacgcccccgcagtatgggaactggaaggtccaatcataatcgggccaataatatcaaaaacactcttgtaattcaccgtcattttagtcatcctcctatttgaatcatcacgttaaattaagctttggcacgggcaactagcgcttcttggcgcattcatcgttagtacatcgtttcgaaactttatgaatcttgaagttacggtacaagcaagcaccacagttgtactgatgagaaaacataaagccgttgcatcaaagctttcatttctgaattaactccgccgttgtgattaatccagcctccagtatggtcattcgattcgcgaccctcacgaaccccaacaccgtcatgcgaatctcgtcaataacactagcaacgagatttatgacaaaaattggcttcaataatattaaccaatgtgaattcatctcgtattttagtcagattactaaataaacaatttgatgatattgaacaggataccactaactgcgattaatccaattaccacaacaaagacattgctgtgtttgccggcatattgctgtaacttaggacttttatgaatggcatacattggcatcaagaacaagataaacgcaatgattggtccaatgatggtttcaatcattcccataatggaaggattgacccaggcaactatccaggcacttagtagcagaacaagatcaacaattgtcgaaacagttcgacttgaaagcgtcttgttagatttttcttccatcttacgaataatcccacgtaagccttcactcgttcctagataatgtcctaaaaaggacttggcgattgcaataaaagcaattacgggagaaacatatttaataattggattattgaaagcagtcgcaacgtaatcaaggattgaaacattttcatttttagcttcaaggatttggtctggagtcaacgccaatgtacaactaataacaaagaacattgcgacaatgaccatcaacgtttcggccgacaatagaattgtcgaaatctttttatcgactttgtccttaccttccccactatattctttacgttcggcaacggaaaatgaagagatgatcggagaatggttaaacgaaaagatcataacaggaataagtaaccacaagtttcctaaagtgccaaccaaatgtcccccagatacagaactggaaaatgttgagaggattgcgccgttccaatgcggaataagataaaaggaaaacagaacgattacaataataaatggaaaggccaggccactcataactttggtaatcaaagaggtaccaaagcgagcaattccaatgagaatcccaacaagtactagcgacaacagccaacgaggtggtgtttgcatgtgcatttggtcggtaataaatttcgatacagtattcgtaatagaaacagaataaactaataagattggataaatggagaagaaataaataatggtaaaaagcaatccaatcttaaagccaaaatgttgttcaacaacatcagtaatgtcatcaccatcatttttagccgacaagacaaacctactcaggcccctgtgagcaaaaaatgtggttggcaaagccaaaataagtatcatgatgataccaagaatacctgccgtgccaactccaatcggtaagaatagcacgccggccccaatcgccgttccgaacaaactcagcatccaaaaagtatcattttttctccaacccttaaatatatttgtcatttttaaatctcctttttataacgttgttctggtcacaccagagaatgtgctaacataacctgcatgaataaccctcccattagatttaacgtctcgactcgttgtaaaacgccactttgtgataaacatcactttagtgccgtgaaaaccttttcttcatgataaaatattatcatggtgacaattaccgttcatgtgatttcaattataaaaattaagcatttttaacaccaaattaaaaaggactgagattaccataacagtcctagcctgtatccatctcaatcctagtgatattaagtttaacattcaaatgaattatttgaataataatttattctcataataattttattttatctctgtcataccatgcatgtaaggttggagcaccttaggaatcttaaccgtgccatcggcttgttgataattttccaaaatcgcagctaccgtccggccaacagcaagtccagaaccattcaacgtatggacgtaatcgaccgtcccatcagctttccggtaacgaatcatcgcccgccgtgcttggaagtccaagcagttagagcatgaactgatttcccgataaacgccttgttctggcatccatacttccacatcataggtcttggctgatgagaaaccagtatcccccgttgaaagcttaataacatggtatgcaagccctaattcgcgcaacacttcttcggcattatccgttaatttttcgagctcatcgtatgaattctcaggtttacagtacttgaccatctcgactttgtgaaattggtgcatacgaatcaagccccgggtatcacgccccgcactcccagcttcggagcgataacaaggcgtcatcgccgtgaagtacgttggcaattgatcttcagataagatttcattcgcatagtaattggtcagcggtacttcagccgtcgggatcaacgtcattcctgaagattcaaccgtgtagacgtcttctttgaacttcggaaattgcccagttccatacattgtctgagcgttcaccaagtatggcggaataatttcatggtacccttgcttttgtgtgtgcagatctagcataaagctgtaaaccgcccgttctaagagtgcacccgcatccttataataaacaaagcgcgcgcccgcgacttttgctgcccggtcaaaatccaagattcctaagctttcgcccaattcccagtgcgccttaggtttaaaatcaaacgttggaatatcgccgtgcttacgcatctcaacattgctatcttcgtcaggaccgactggtacatcatcggcaggtaaattcgggaagcgaatcgctaagtaatgaagccgatcgtttacttccgtttgggccgcttccgtactcttaatatcaccattcagctgtttgacttgttgaatgagggcttggcccgcttccgattgcggatcactttgcccaatttgttccgtcaactggtttttctgtttcttcaatccttcaaccttggtaattgcatcccggttttgttggtctaactgtaagtattcatcaacctcagccggatcaaccttccgagtctggagcttagtcttaacaagttctgggttattacgaacaaactttggatttaacatacgaaaagcctccttaaaattaaaacgtcccatagtcttcacctaaaagactatgggacgttttttatcaacgtggtaccacccaatttactgctctacgagtatatcgtctcaccgcgacctcttaaaaatgaagtcaaacgctaaatggcggattcatcagtccaatcaaccaactttcagcaaccgttggctttctaaataatcagattaactactagcccattatgtttgcgctttcaatttacacttataatctagacctcctgccaattattgtcaatagttttttattatcattttatttttctattatcaagagaaccatttattgttaccatgtattttcgcaacaccagttgtcactgtgaatatcggtgacctaatcaagcccgtggccgcccaacaaaaaaaagcacaccaacaattcgctggcgtgctttactcttaattctaccgtactaaatttatgccttcactttaccagtctggttagcggcatcgatgaatgccttgaataacccttctggacggttaggccgtgataagaattctggatggtattgtgaggccacgaagaagcgcttctttggtaattcaatcacttcgacgagccggttgtcaggcgaagttccggagaagaccatgcccttagcagccattgcttcacgatacttattattgaattcataacggtggcgatgacgttccatcacaacttcttcattgtggtaggctttagccgccacagttcccggcttcagcttgcaagggtaagcgcctaaacgttgcgttccacccatgtcttcaacgtcttcttggtcggccatcaaatcaataatattgtccggcgtcttcggatcgatttcagcagagttagcatccttcaatccaagtacgttacgtgcaaattcgacactggccatttgcattcccaagcagatacctaagaatggcacgtcgttttcacgggcatacttgattgccgtaatcttaccttcaattccccgatcaccaaagccaccaggaactaagattccgtcagcatcgccgagtagttcttcgacattttctggcgtaacatcttcagcagaaatcttcttcaaatcaatgtcggcatcatccgtatagccagcatgcttcaatgcttccgtcactgagatataagcatcctgtaaagcgacgtattttccgactagcgcaatcttgatggtccgtgataagttctgaacatgatgttctaagtcaatccattcactcatgtcggccttaggtgcctgtacatcaaaatggtcaaggacgatttggtccatgttttgtttctgaacattcaacggaattgaataaatcgtcttaacgtctaaggattcaatgactgcttctggttccacgtcacagaaggacgcaatcttattccgcatttcccgcgtaattggttgttcagtccggacaactaacatgttcggctgaatcccataactccgcaattccttaacagaatgttgcgttggcttcgtcttcatttcaccagctgcccgtaaatatgggatcaatgtggtatggatatagaaaacattgtcggaacctaaatcactcttcatttgccgtagcgcttcaataaatggcaaggattcgatatcaccgaccgtcccaccgatttcagtaatcacgatatcggaatccgtcgtcgtacccgcacgcatgattttttccttgatagcgttcgtgatatgcggaatcacttgcaccgtggcgcctaaataatcgccccgccgttccttttgcagaacttctgaataaatcttaccggtggtaacatttgaatatttattaaggttaatgtcgataaaacgttcataatgtccaaggtctaagtcagtttcggtcccatcatcggtcacgaagacttcaccgtgttgataaggactcatcgtaccaggatcaacgttgatatagggatcaaacttttgaatcgtgacctttaagccccggttcttcaataaacgccctagcgaagcagcgacgatacctttaccaatggatgacacaacgccaccagttacaaaaatatatttggtcatgtgataactccttaaagatttatttcgtggggtggtataaataaagaaagctccctatttcaacagaaatagggagctaatacgatcgtttgtctcaggtatttctaccagagagcccaaataagataatacaaggagattcccttttcgtcaaggaaaaatcttgaaaagcttatttcgattcgtcgtcttcgtcatcgtagtcgtcatcatcatcgtcatcatttaactctgataattgaccctcgataccgtctggcaacgtttcatcagcaacatcgtcgtctgtgtcatcaacacccgcaagttcatcgtacttgctgcttgctgaatcatcagtatcgtcgtcctgatcatcatcgtcatcgtagttatcgtcatcttcgggatcatcgtcatcgtaatcgatcacgtcgtcatcatccccggcatcggccaagaaggcgttaaccttcttacgcttcttgcgctttggccgatcctcatcttcgtcatcgtccgtatgaataacggcttcgtcaatggattcaaatgggtaccatgcacgcaggccccacatattgtcaccgagcgaaatgaaactaccatcgatattaagatcggtataaaattgtgataaacgctcccgaatttcttcgtcgcttttacctaaatatgattgcacagcgttggtcaagtcggcaaaagccatcacatcaccatgttgtgataagatcgcgtgagcaacctcgattaaagataattcggactttttttgtccatcaaattgttttagttccaaactggtgcacgtcctttccacagtttatagtacataataccaaattaggccgtgaattgcaatcgcaacttgtagttaccaagtagctgctcacccgcgtataaatcgtaatcaacgttcacctcacctgaaaatggccgttcacgtagccgtactcgtaacatcggcgtcaccgtttcaacaggtagcatccccataggcgtttgataatgagcacgcacccgtttaccattggaaaagtgcaaccgaagtcggttctccgcactccgcgtcaacacgacgtccccattagctgccagcttaatcgtcactggaatcggttctggcgcatcatcgttaacttccttataccgtaaataaaacgcgtcacccatctgaaccaattgaccatcgacatccagtgcatagttcgccgtatcgtcatcttgccgcgcctgcgtctctaaatgaatcgccactggcacaccagttgttaaatcatccatatttggacctcctaatatttcaaaatcacacgctgaacgcccgtctacgatcaccgtgttaccacactcgctatatccttttcagcgttcacgaccgcgcgactcccatcacgcccatcgtaaaacttcctgtttaattataagccattcatgccaaaataactaaaaataggactaaaagcggtcagcttagatctgctgggaaaagttcgaacacgcgtaaactttttgagtcggctgtgttccaacaattgtcccccagccccggaggtcgaaataggccgcacgttgctgacgaacaaaaagccaactaacttgcacgtttcattatcctatgatggtatgctacagattaagttgatttgtctaagccaatgcaacagtaccatttttctagtataattagtgatgatacggacaacggtggcggtttcatcatgagacatccctcgtgcccgataatagcggataacggggtggctttcttgacggaatcaacaattgcaactttgagtcaaaaatacgaaccggcagcgatgctggatagttttgcgtatacgaacgccttgctgtggttaacggcggctcgtcagcaaccaatcgttcatttctggcagttacagccaaccgtcattctcggcttattagaccaacgcttgccacggctaactgctggcttagcacatctacacgctgccggttatcaggtcatgctccgtaattcaggtgggctagccgtagttgctgaccctggtgtactaaacgtctccttatttcttccagcaactcgcgaacgctattcaattacagcggcatatcaattgatggtcgactacgttcaggcagtttggccacaattaaatatcacgactggtgagattacacgctcctattgtcctggtgattatgatttgagtattgccggtcgtaaaattgccggaatgtcgcaacggcgcactgccgaagcgctggtcatcatgctgtatgtcagcgttgatggcgatcagatggcccgtagtcaactcattcagcgtttttaccaagtcagcttagccggtcaccatgacgcgcggtttccagatgttgatccacaagtcatgacgaccgttgctgacgctttggcagcgccgactgacactaccgctacacaagctcgttttatagccatcctagctcaacatgggacggtcgacacaacaagtttgccgttagtcaccgaagaacctgaatttcaagcacacttaaatcaagcctatcaacaaatgcaacgccgacaacaacgcttgcatcactgaaagaaggaattaatttggcctatcgccagcaactattacccatggagaaagtctttcgtgacccggtccatgattacatttatatccaacatcaagtcattctcgatttgatcaacacctcggaatttcaacgactgcgccgtattaagcaactcggtacgacctcgctgaccttccacggtgcagaacactcccgctttggacattgcctcggtgtttatgagattacacgccgtatttgcgataacttcgaacgtaactacccgacccaggcccctggtgacggtggttgggatgatcacgagcgattggtcgcactatgcgccgccctgttacacgatatcggtcacgggccatactcacacacattcgagcacatctttcacaccgaccatgaagccctaactgttcagattttgacatcacctgaaaccgaggtcaatcaggtcttacagcaagtctcacctgacttcccggcccaagttgcggccgtcattcaaaaaacgtacccgaatccccaagtcgtccagatgatttctagccaaatcgatgccgatcggatggactacctactgcgagattcgtacttcacgggtacgaattacggcaattttgatttgacccgtattttgcgcgttatgaagccgtatcaaggcggcattacatttgcaatggaaggcatgcacgcggtcgaagattacattgtcagtcgcttccagatgtacatgcaagtctatttccatccagtatcacgttccatggaagtcatcctagatcgcctactggaacgggctaacgatctttatcaaagccacgcggtcgacgctgaagccacaccagtgatgttattgccgtttttcaataataactttacgttacacgattatttacggttagacgatggcgtcttaaacacttattttagccattggcgtgatagccgtgatcaaattctcgctgacctagcaacccgtttcttagaccggcgtcccttaaaatcagcacgagtcgatgcaacgactcaaccgctaattccaacgttacaaaaattaattgaacaagccggctttgatacgcactactacactgacatcaacgacagttacgatcttccttacgacgcctatgatcctaagatgaagaagccgcgtacccagattgaactgcaacaaaaagacggttccttactagaactatccaccgtcagtgacctagtgcgagccatcaccgggaaagtctctggcgatcagcggtttttctttccaaaagaaatgctcagcaaaaacgccgaaaacgatttatttaaaccaatttaccaagaattccagcaatatattttaaacgatcgtctggtcgtaccacactaattttggaggaattattattatgtcagtcaagcttatcgccatcgatatggacggcaccttactcaatgagcacagcgaactaaatcccgcaaccgttcaagcgattaacgccgctaacgcgcaaggaatcaaagtcgtcatttgtacgggacggccattaagtggcgtcacgccctttttaaagcaacttggaatcgctggtgaagataattacgtcattacttttaatggctcaatggttcagacaattaccggtaagatcatcacaggacttaccctgtcacatgacgattacatcgacattgaaacgctcagccgaagactcaatatccattgtcacgttgaaagtgaagaccatatctacaccgccaatcgaaatatcagcccttatacggtcggcgaaagtgcactcgtcaatatgccgattcggttccggacaccggaagaaatgcgcccagacttaccaatcgtcaagtgcatgttcatcgatcacggcccactactggatgcagccatcaagcaattaccagcgtcattctccaagcgctttaccattgttcgctcagaagcgtatttcctagaattcatgaatcccgccgctagcaagggtaacgccctagccacgttgaccgaccatctgaacttaactgctgatgaagtcatggcgattggtgatcaaggtaacgatttgagtatgctgcgttacgcaaccaacagtgttgcgatgggtaacgccattgatgaggccaagcaaattgcccgttatgaaaccaagactaacgttgaagacggggtcgcacacgccattaacacttgggcactcgcctaagctactatttttcaaactaattcaagcaacgctaatggctcgtttttaacgtgccgtgagcgttgcttttttatcactgttatgaccgttacccagcgttttctaaacaatccagtcaaacaaaaaagtgacgatcagtcattacctgatcgtcactttttaatgctggttattcgaaactaccagttgcactattttccttagtaacactaccactatccggataataacgataagtatccgttactgtcttggaagcagaagaactagactcattcgtcgcatagattgcggtaatctgataataagcactggtctccttagtaatattaaattcggtatccgaagtaaacgtaacaccggacgcatcctgaaactgtttgatgatcgccgaagttgtcagctctgaagaactactgctggcagacgcgctgctattcgacgaactcgtcatcgttgaactatcggcactagtactactcgtactgcttgaagacgtcctactatcactcgcactagccgcagaactcgaactgacaaccgttgagctatcactaccagaactagttgattgcgacgcctcataattcataatggcttgtttcattgccaaagcttttttctgtaattttttgataaccggatgtgtggcttgcacatcgtccaacttatcaatattggccttcgcagtggccaaatcatgaatacttaattcatcacgggcagcgttatagtaaccattggctagcttgaccgcctggtactgcttgacgagcttttgccgagcagcaataaaactggcgtcagtcgtgccatcataactacttaacgtgtcaaaataaccctttgctagactgagctgattattatcaagtgcttcttcagcttcctgataatactttaacccaagggctaactttttgatcgctggagttgattcagaagcacccgctaaagtcttctgggcagcggcaattttttgttgcgaaatttgctgatcagctttggttaaaacggccgttgtactgttaccagttgcggtcgttgccgaacttgcggttacgcctccggtatttttggcacagcctgaaagtgtaatcaatccgagtaggacgattacaatcagtggccaagatgatcgataggcatgatccacggcaaacccctcctttttatcattctccattataccattaatcgcaatgtcatttttttcaaagctctgagtagcggctttgttaaattaacctaactaacgctgcgacataataagccgctaaaccaagtaccaccactaagttggcccagcgatacatcacaattaaggccaagtattcccgaaacatagcaaacggtaaataatacagtggcgtatgcgccccgattcccgttaggttcaggtgcagttgccgagcaaaaatattagcccgtaaaacgtgatagccactcgtgacaatcacggcgcgataaaacggttgttgccgcacaattaatgcgtgcgaaaattttagattttcaattgtcgacgttgaccgattttcttcttgaatggcatcacgggggaccccttgatccactaagtactgccgcattgcggtactctccgccataacctcatccggcccctgaccaccagaaacaacgatcgtgattggttgatgataacgcgcccgttgcccccggtagtacttcgctgccgtctgaagccgatatgccagtgttcgcgttggctgcccatttggcatcaaccctgctcctaagacgatcatataatcgatctgtcgatgacgtcctagtcgggtcatgacgcaagctaatagatacgcgataaagctgaacgcaaaatacgccgtcaataataacgctaggcctaataactgccacaagcgtcgcgaatgccaaactcctaagttgattactgataagaccagcattatgactaatacaccaccgacgattgctagcaagctgtaatgaaacgcccagccctccttgcgaatcaatcggtaactatacctgacaaaactaatgcccacaatcaaaattacaattggcaacaacgtataagccaagatttttgcaccgaccaacatgaattgccaagtaggacttgcctgcgcactgaatcgatggtaagcgcttaacaaaatgccaatgactgcaatcaaaaaaagatgtcccgttaaccaatgccgccggtccgtcaattgcaaggtcaacgcactagcaagggccaaactaccccaataaaacggtgtcatcgcaacacccccttaacttatattgtaatcattttaaggattcgtgctagtgtttatggataaaaaaaggacgccggtagcccgacgttggtccgttatccgttccgcgccatcacctaattaatgttgaagcacgccaaaacgaaagattcgttgatatacagcgtccagtccaactttgactaggtcacaatgcccaccaaacaacacctttactctatcacttttagaaattactgcaacttaaaaagcgtcaaatcagcaattgccaatttgacgcttcgtcaattaattttcttcgttatggaaacgattcttaaataatggactaactggtttattttcatggataaacttgattgcttgacccattaattgaccaactgaaacttgttcgatcttatcgattcgcttagcagctggtaattcaattgaatccgtcacaactaatttcttaattggtgacttttcaatccgttcgatggcaggaccagacagaactggatgcgtacaactggcgtaaacttcagttgcgcccgcatcaaccagtgcctgtgcacctaaagtaatcgtcccagccgtatcgatcatatcatcgatcatgatggcccgcttacccttgacatcaccgataatattcataacttcggcaacgttggcccgtggtcgacgcttatcaataatcgcgattggtgccttcaagaattcagctaatttacgtgcccgagtcacaccaccatggtcaggtgaaacaaccacagcattttcatccaagtggtggttcaggaagtagtcagctaacagcggcgcacccatcaagtgatccaacggaatatcgaagaagccttgaatttgggcagcatgaagatcgagtgccaaaatccgtgttgcaccggctgtttccagcatatttgcaactaacttagcggtaattggttcgcgagaacgtgctttccgatcttgacgcgcatatccgtaataaggaataaccacgttaatggtcttagcactcgcgcgacgtagggcgtcaatcatgatcaatagttccatcaaattgtcattaacgggagcggaagttgattgaatgatataaacttggtcaccacgaatactttcctcaatgttaatgcgaatttcgccatcactaaagcgatcgaccgaagtcttacccaacttaaccccaacggcgtccgcgattttttctgccaatggtttatttgaattcaaagcaaagatttttaactttggatcaaaatactgttctgacataatttcctccattcgaaaatttattacttactaaataataggcattttgctagtgaaaatcaagtcccaacaacaaggcaaaattgcgtgagactgggctggaagcacgactttcggcaatctaagccccttcgtgattaaagattaaagtttcgtgagccccgattaccgaacaatcttagttaatgagaccgctatcagttgtaattggtactgacacacgcattgtaccagttattgccttagttggtacttgaccgctgccgtttctcgcgttcaaaagtaaccagtcctagaagtcggaatagagcgcacaccggctgacgaacagggatctactaaactgttcagttatctaaacacactcagtggtgctgatttaaataagtcacgacatcgcgccccaaacgattcatcccttgatattgttggtactgcttgccattctgggccatgacgacaatgctataagtgccttgtttggtcttaaaaatggccgcgtcgttttggacacccttatcgggatattcgccagttttattatagaccgtggcgtgtttaactaagtatggtagcttgctgtggttgcgacagcccttaagtaaggtcaacatcttcttatcatacgtcttacctaataacttatgttgatatgtcagcgttaaaaaacgagttagatcagccaccgacgtgtaattatcgcgtccccagcgtagcgcgttcgtatcaagcatataccgttgtaaaaccgtctgcttgaatcgataatgcttaatggccgcattaacgcccctgaagccccccgcacgtttgatcaaccggttagccgcgttattatcggaattatgaatcattaattttaaatcattttgatcttgctgtgttagccgtaactttcgttgttggacccgtcgataaatcgtcagcataacataaactttgatcgtactagcagaacgttgacgagtcatgcgctgatttcccgtttgcacggttagttttcgtcgacctaatcgggtcaccttgaccgaccagcgcccacctagtgatttcaaatcacgttgcgcgatttttttaacggctgtttgctcacttttaacgctagttgcgtgtactggtaatgcccagctccaaccgccaagcaatgccagaccacaaacaaggccgcgaatccacttcttcgtctgcatctaaatgcctccaaacttccccgtcccgtaaactcctcgccaattataccaatttcgtgacttaattaaaatcactcagttgccctgaactgacacagtcaaatcaactttgtcctatttagcagctaaatagcccttattacaccacaagtcacgccgatgagctaacaaaaagagaccatcccagcaacaacgcacttggatggtctctgaattcaattatcaatgataataattacatgttttctggttcatgtggtaagcggccccagaagtcaggcttgttcgtctgacgtgcccgggcaattgccatatcatggaagttaacatcatcagtaatggtcgaaccagccgcgataaacgagtggtcagccacttcaactggcgcaatgatgttcgagttactaccaataaaggcggaatcgccgacattcgtgtggtgcttgttgactccgtcatagttaacgaagaccacaccacaaccaacgttaatatcttgacctaacgttgcgtcaccaacataagtcaaatggccgaccttggtccgattaccgatcttagccttcttgacttcgacaaagttaccaagatggacgtgttcaccaatctcagcttgcggccgcaaatggctatacgggccaatattgctgtcagcgtgcatgatggaatcttccaagaaggaagccgtcacccgaacacgatcttcaatcaccatgtcatggatctcggagtgcgcgccgatgaagcaatcttcaccaattgtcgtatggcccttgatcaagacgcctggttcaataatcgtatcagcaccaatcttaacgcccgcatcaatataggtatcgtcagggttgataattgaaaccccattttccatatgctgcgcgttgatccgttgttgcatcactttggttgcttgggctagagctgcacgggtatttacccccattgattcatcaaaatcatccatttgataggcggcgaccacatcaccctgattcttcatgatctgaatcacgtcagtcaaataatattcgccctgtgcattatcgttggtcacttcatgtaaggcggcaaacaacttctgattatcgaagcagtagactcccgtgttaatttcatgaatttcttgttcttccttagtcgcatccttttgttctacaatcttttcaacgatgcctaaccgattgcgaacaacccggccgtagccttgaggattaggtgccttggacgttaaaatcgtgccagcggcacccttagcttgatgatattcaaataattcttcaaaagtttcagctttaaataagggtgtgtcgccactgacgatcagcgtcatcccatccgcatcttttaagagcgattcggcttgtaatactgcgtgaccggttcctaattgttccgtttgaaccgcgtactcagttcggtcgcctaatgctgcttccacatctttggcaccgtggcctacaatggtcacgatatttgccatgtgggtggcttcaacttgggtcaagacgtggtcgaccatcgatttgccacagacctgatgtaatactttgactagcttggatttcatccgggtccctttaccagcggccatgatgattgcatttttggttgtcattacaaattactccttagtcctcagataagtccatcatatcaaaaaactggtctggataacacaccaggctagacttccgcaccgaaaaccttctccaaatagttaccagcaacgactttaatcgccttgtcactatcacttacgttggttacccgtaataacgacgtgtagtcatcgattaaacgattgccaacaaaactggcttcggcaaaaacggtgatgccaattaaattagcatcaaattcttcaatcaaggtcttcatcccgttgattgtgccgccgcccttcatgaaatcatccacgatgagcacgttggcgccttccgttaggcttcgcttagaaagttccatcttcttgatccgttctgaagaacccgagacatagttcacactaacggtcgagccttccgtaattttagaatcattgcggacaatcacaaacggcacatttaaataagtcgcaacactttgggcaatcggaattcctttagttgcaacggtcataacagcgtcgattttttgattcaagtactgagtcgcaatcacccgacccacttggcgcaaaatatctggttggcctaaaatatcagataaataaacatagccacccggtaacacccgactcttgtcggcaaccttggtggtcatctcgtcaataaattcttgggcctcttcctttaaaatataaggaataaaccgcgcaccaccagcagcaccgggaatggtttccaagattcctgttccccgggcctgaaatactttcttcaaaatcgttaaatcttcactgattgacgactttgcggatgcgtaccgttccgcgaagtatgtcaatgaaactaatgtatggggacgttccaacaaatagcgcgtcatatctattaaacgttcgcttctacgtactttcataacttccacctcaacctaaatcatcatttttaaagtctatgcaaaatgataacacaaacgttcggaaataagctaattttttcacgtttttttactaaaccatcggaatttcttaatatgtttgccaattatcttgtctgtacagctcatatttggcgaattcgagaacaataaacttaggcaacttataacggagtagatacggaatgtgccaggggaatccatcgttcacacgacgtagcgtccagaaagttcgattgattggtcgctacttacacctaaaaagcccagaacgagtaattttggaatcgttctgagctttcaagcaatttattttattggcttctgcttattgaatcgttgtcgtccccaaacaataggatatagacaacagtaattaccaaattaccgactaaacttttctataaaataaccgatactcggcaattagtccttgtcgaatatcggttatcttaatctgactaattcatgttacttattggcccggtgcttacccccaacaaataagccatagtaaatcaaactgaataacaagctaccgagtaatgacgatactagcccatgtgtcgtagtttgtgtcatcacagctaagattgctcgaacagcaaagtaagctactggaataatagggccaacaaaattagattgattcctttttcccagtaaataactccagtatcctaatcccagcgtaattcctataattactactccaataattataatcgttgccatttttcaacctgcaatcattttttgccgttttcatactcttttacaatatctaaaaaatcagtcctctcgttggtttctcgtgcataatctataatggatttcccaaatggatcacacaaacgataatctgagcccgcctttaatagataaaaatataactcttcattttccttagtatccaaatcattatcaaaaaccgcataaaacagtggtacatgtccatacttatcaacgctatttacatcgatgccgttctcgactaatagtttcgtaatttccatagcaaacttaggatttggacgccatacacaattgtaaaaataatgtaatgcgtttcgatgttcactcttggtgacaaagttaacatcaatacctgcttgtaacaaaaaatgaacaatctttaacttttcctcaggattgtcatcgtttgtcattgccatgcataataaattaagtccttcaaacttatcagtctcatccacattgccagaataataatttttaaactgatcaaatgttccatctcttaccgcactaaaagcattgtaaactagcacactttttacctcgtttcatatttatgactccgattagcagacggagtttctaatctagagtttttgggattaaattgaaaatccttcaatgtcatcttcctatttttatatagattgaacatttccttataagacttacctggtagatgtccgagatcgacctttccttttcggggttagcccggcttccaatgtatcacttgtttcgtatttcgatcaataagcactccatctttagcttgcctattatatacttcctgctcgaattcgagttttttcttcccggttaatgttggtcgtccataaggttttccgttcctaatataagagccattttccaatgggacattatttgtctttttatctttcccatcttttgaagatttttccttgctagatttctcctttttcccatgactatctttattctgcgaggattgttttctctgagaagcttttcttgccttgcccgcagccttttttcttattgtagcgcttctgttgcgcttcttggtcttgtgttttgtcgcatgagaagtctttttgggcttagacttttgatgtcccatgcttggtctttgtagttttgtgagacttcgtggctgctttcttggtcgtcttcctagccggcttacgtttggccaattcctcagccgcacgcttcattgcctgcttagttgcccgaccggcatgcttgacccgaccaccattcttcgcaactttctcggccttcttagcagttgccaaaagctttgtcgtctttgctaacttagcgaccttcgagaccggcacaaagttcaaggctgtccaaaacgcacccttcaaacgagaacgcttcttaccagtagcgcatctttccccgtaataatggtataaatatcattatacccaatcatatccgtcaaaaacgaaatgatacctttactgattcccgtcctacgactaagtgtggcaattacagcgctacccttggacttatgcttttagaaaacttcttgtgtgacttgcccccccccacgcaaacgaaaagttgcaaccccaacacgaacaaaaaactagccgctctagaattcccaatgaattccagaaacgactagtaacattttagcgtgtcacaacgaaccacttaattctgtaaactacctacttttaacgtgatacagctgaacaagaatagccccactagcttccgacccgaagtcgctgataacccagcgcggcaaagtagaagatacactcgattgcagcgatgaagaaactgactggtaaattcgtgacgtaactcaagtacagccccagccaaaccccaatcaacgcgaaaccaatcgctagaaaaatcatcttgctaaccgtatggacaaagtatcgcgctgccgctgctggtaacgtgagtaagataaagatcagtaatgaccccacaatttgggcagccacgctgacgctcatcgcaacgagtaccaagaagaccactgagatgccggtcgtccataagccgctcacccgggcgccaatcgcatcgaaggaatcaaatttgagtggccggtacaagcccaacatcacgagtaggacgatggccgataagattgcgacccggatgacatccgcactggcaatcccaatcacactcccaaacaggatgctcgtcgcataactcgaagtttgattagataacgacaggaatagaatccctaagccgataaacagagcggaaattgcagaaatcgaggcttcgcgtcgtgattgtttcacactcatctgccccacgatgaccgaactaatcacggtaaaaatcagcatcccactcaacgcggtccagcccataaaaatcccgaaggctgcaccggcaaacccaatttcagacagtgtgtgtgtcagaaatgagaggttccgggcaatcacgaaaacgccaatcgtcccacaaataattgcaataaaggttcctgctaagtaggcatttcgcataaatactaagctaaacattgacattagtggcctcctttaattgctctaccgacatatcagcgatattgccaaattgctggtggccgggctttaaggccagataatgtttggcgtattgcttcgctaatggcaagtcgtgcgtcacaaagaagacggtaatgttgctagtttggtttaagttctgaacgaggtccaacaattcatacttcatttcattgtccagactagccgtcgattcgtctaaaattaatagctgcggttgttgcacaattgcttgtgctaagtaagcccgctgcttttcaccaccagaagccatcccaagcggtcgctgacggagtttcttcaaattggtcacggctaatgctgtcgctacctgacgatgttcagctcgagacagccacggctgccacccttttaggttcagcccgacaaagtcctcaatcgttaacggatactcctggtctaagttgcgaaattggggcacgtagccaattttaatggcttttttattcggataatacttaatttgaccggctgttggcttcagcatgccaagcaaggcgcgaattaaagtggttttccccaccccattctcaccaatcacggtcaaaaagtcaccttgttcaatgttaaaattcaaatctttaaacacctggttgtttggaaagccaattccaaggtgttggacggcaattaacggttccgtcataacactaccccaactttctaaattaaagtaaatcgtaatgattactattttagtttacctgaatgcagtgatttgtcaatacctgagttcaaaatgccgtaatcattaccagctgcggcaatcatcagggcctaatcaaataacaccttgaccactagttgaatgcgcttgtcactaagacgagattgcaaaaaaaagaccgtttttaccgttaagccggtaaaacacggtcaattcatgtttatcattactttaatttaaggtgcttaagccaaccccgcctgctcatgcaagaattcatccaacacttcttgatagcgatccgggtgcgttcggatggcttcaacgtgaccagcatcggggtcgatatacaggcccttttgttgtggtaactggtcgtacaaggtatgtgcattgcggacaggcaccgtctgatccttggaaccatgaatcatcaagatcggtaacccaccatcaatcacccgttgcagaatccggccatccttaaacccatagcccgcgcgaacgtgtgctaagcgattcgccaccggcataatcggataggctggcaagtggaacttatgagtcagtctgaacttcgcttcatcataaagatccgcataaccgctatcctccacaatagctttaacattctccggtaacggctcaccactagtcgccatgaccgtggcggcccccatcgaaattcccatcaatacgatgtcaatatccagacctaattgactaagcgccatcgtaatccaacgttcataatctagtcggtctagccaaccataaccaatcgtatggccttgactatcaccaaatgaccgagcatcaggcatcaagacgtcatatcccaagctcataaagatgcgcgcatacggaatcatttgttcgcgcgaatgtcctagaccatgcgccaaaatcgccaagcggccaattgttttcggattagggatatatgttgcgactaagttcagcccatcaaaggactggatcatccactgctgtttaggctgcttgaaataccaaaaattctcaatttcagtgttttctgcccgcgaacgttcgcggccccgctgcttctgtgcgtcactcacgtgcatcgcgacttgatacgccgctaagccaccaagtaacgttcccgcataagttgcagcaccaacgacgcccgccagtttcaatccaaattttgtcgactgcttcatccgaacacctccgttactccttatttaatcataaacgcgcataaattgcttacaaaaagagattgcgttgtccgaataaccgatgatgcgttgaaggcaacgaccatcttcgtgtgtcagcctgcaagcaaagccgcggctactcgcattccggtgccaattgcactgctacaccatctctggctggacacaggtcgtgatgacaaatggctcagcgctaccgtttaagcgtagcagtaaattagagactcggctcacctaagcccgtaccaataaaaaaagcccaccatcacggcggactactgcggtctaatattcatttaaattaaccggccgcacaaggtatacttcccgacaaaaacccttcaaggaattatacacgcgttgcgcccgcgattgtttgcgacacacaccgaacacagttggtccggtgccgctcatctgggccgcatccgccccaaacgttaacaattgccgcttgatctgtaaaatctcggggtagcgttttgccgtgattggctctaaaacgttgcccatattcgcaaaaatctccgcaaaatcctgctgttgaataccagccaacaaggcctcaatattgggatgctggtcgatgcgctcgtaattgacctgccgcaaaatatttggcgttgacacactgactttcggcttcgctagaataatccacatcggcggcaacttaggtagcggggtgactacatcgccttttcccgtcacgtgggccgtctgactgtagacacagtatggcacatctgaatctacttgcaatcccaaacgtgctaacgtggctaagtccaagtggagattccacatccggttcaagccccgtaaaacagcggcggcatcagatgagccgcctcctagaccagccgctaccggaatggcctttcttattttgatacggacaccccgatcaacatgacaataccgttttaaaacgctcaccgcttgaaaagctaagttacggcgatcattcggcaaaaagccactatcggtgaccacttcgattcggttcgtatgcaatgattctaacatgacatagtcggccagatcgaccgacgtcatcaccatgtcccactctttatccccatttggatgttcaaataaggtatccagtcctaaattgattttggccggtgctttttcaacgatctgcacgcgtctcaccctcttccatgaccgcgattacccggggtcgctgacttactttgatacaattatactaatatcaaggcaaaataaaaagaccttgcttgggggtcttaatattgagaattcacgagacgcgaattaagcttcagttgtttcatcatcaaaagcgatttgaacgttctttgtcagaacatcagtataactgtaggagacccgttcaaatgcgttttcttgttgatctaaatccacaacgaacaccgaacgataagtttctttcaagataccgtggcgttcagttgttttcttacggccagcctgggcaacgaccttcatgcgttggccgatccgtgagtcaagtttatctttaattgcagctagtgaaattggcattgagaatcctcctcatgaaagacactatactagcttttcacaaaaaagtcaatattatatcacaaggttttctaatgtgcaaccattttataagcatagataacttaaagtaagtcagcctgatgtaatgcatccgtcaatgtaataaattcatcgaccgtcaaccgttcggcacgaatcttgggatcaattgtcgcgatatcaagagcctgttgaatggccgtcttcgtctcaggttgtttaccaaataggctttgcaaattattccacagatttttccgacggtgcgcaaagcccgctttaacgaccttgaaaaaagctgcttcgtcaaatggcacgtgtgtccgcggtggcaatgccgtcaatttcacgattgcagaatcgacattcggtgacggcacgaaaaccgtccggggaacgaccatcgccatctcagcagccatccggtactgcacagcaatcgttaacgcaccatacgccttcgtacccggttcagctgccaaacggtcggcaacttccttttgcatcatcacaacaatattttcaaaagcaacgtcccccgccaaaatgttcatcagaataggcgttgtaatataatacggtaaattggcgacgagcttcaacggccgctcgttatctaaatgttcactgatcatcgcggctaagtcggccttcaaaatatcttggttaacgaccgttacattgtcataatcagctagtgtctcatccaaaattggcagtaaccgatcatcgatttcaaaggccaggacgtggtgcgcagcccgtgccaaatactcagtcagtgccccgatcccagggccaatttcaatcacgttatcattggttccaatgtcagcagtggcaacaatgttgtgtaacacgttctgatcagttaaaaaattctgtcctaaactcttcttaacttgtaacccgtacgtatgcataattgcccgtgtgcgggcgggattcgcaatatctaaatctctactcatcatttctcctctgtggttagttggtcaacagccgcccaaaaatcagctggctgaatttgaaatagttgtaaccgtttgggcagctgtttaccgttgacgtatccgatacctaaacgttcacccaactgttcgcgtcgttgacgcgccgtgggacccgctagtaagcccgccgcaatcaaatcatggtgactgatcaactgttggggctcgtcgatttgctccgtatatagatgggcaagtgcagtttggatcgccgctgggctcgcgtgttcaacgcccaggctccccccagccttagttggtacaccagctttgcggggcaaaaaggcgtgcttgacacccggaacagccgccgaaatcgtcttccgaatacgttcaccggaaaagtctgggtcggtgaacacgatcacgccgcgactggcctgcaacgttttgatctgggctaaggtggcttcggaaatcgccgagccattcgtttcaagtgtatctgcatcgacagctagggcgagacgcttcgtgtcatctttcccttcaaccacaattacttctttaatctttttcaatcttaaaaaattcctctgcattttgataagtttgggccgctataatttccggcgtcgtttcacgtaacttggcaattgcttcaacaacgtaccgcgtgtaaccgggttcgttctgctttccccggtatggttccggcgttagataaggggcatccgtttcaaccagcatttgcgttagtggcgtttgcttgacggattcatggacttcacgcgcattcttaaatgatgcgacaccactataggaaatatgcatacctaagtccaagaaccgtttgagccactcagggtcaccattaaagctatgcatgacgccacccgtgtcacgaatatcagctgctttcaagatcttataggtatcttcgaaagcatcacgattgtgcacggaaattggcaattgcatctctttagcaatggcgacttggcgggcaaagacttgccgctgaacgtcttgtggcgacgtatcccaatggtagtccagtccaatctcacctaacgcgacgactttcgggtgttggacttgttcaatcaacaacttttcagccgcctgatcatagtttttggcatcttccgggtgccaaccaacaatcgcgactaactgaggatacgtttccgccagtttaatcgcatcggcgttcagttgtgtattcgaaccaacgattgccatccgcgtaacatcaaggtcagccgcttgttgtaagtaacgtggcacttcctggatgaattcttcactatttaaatgggtatgagaatcaaaaatccgcatgtaataaccccttttcgacttttgttatcttagttgattttaccatgggacgcaagttttcggaaaagaagacggtaattctaaaataaaaagcccgggttcccccaggctttcaagcaaaatcaatgacgtacacgctgccaatacagccccgcgtacaccaccgtcatcaccgtgactacgcctaacatgtatacgggcaatgtcacgacactgccgtggtggagcaaactcattaagtaagttagcacactcactagcagataataacccaggctaaaccagccactagcactccccatcaccgtttcatagccaatcaaagcacgattcaacgcgtttggtagggtgatgttcagacctaagaaggctagaaaaatcccaatcagcattccaatgacgtgattgccaacagcggtcatcaccaagccaactgccgctaccaaactcaatcctaagccacttaaagcgacctgcattggtgaccaatagttgacaagccaattcactagcaacgcgcccagcagactggccgcggctaagactaaaccgagactaccgtattgcacagcactaaagccgaagtgcgtttcaaaaataaacggcgcttcagcgtaataactaaacaagataccattaataccactaatcaataggccgtaacaccagaccacgggatcgtgcaataaccgtgaaacgacaacgctttgttgccgccaagaggccactttgaccgtttctggtcgagtctctggcaagcaacaccccgcgtacaacagtattacgactgctatcatgatcaagaccgagaagacatgctgatagccgaacacagtctggacgccacctccgatgagtggcccgagagcgggtgatagtgccatggccgcactcaccttcgcaaagatttttgcaccagtaacacccgtaaagctctcacgcatgatagtctgtgtcacaaccgaaccagcactagcaccgaaagcttggatcaagcggcaaaccaataaccaagtaaagcccgggctcagatataaccctaagttaccaatcaaataaaaggctaatccacctaacatggcatcacggcgcccgcgatagtcagcatattgcccccagaagagcaccccaactgcaaaagccacaaaataactgctcatggttagctggctgtggctggcgctaacgtgcattgcctgactgagtgctggcaagatcggcgtaaaaattgattcactgatttgtggaaaacccactaatgtgattaacagtaataatgatggcacttgtttttggacgtttttcatttaattaagtctcctaaatttaattaattttcggaaaaacgtccttttccatctacggagacgcatacgagaatctgttcatacttcatatgttctcacctcatttcttgttcgtactactgtacgggagattaacccatttgtcaaaaacaactaaaataacaattgaattacaaataaaaaatcgagctcactagtcagtgcgcccgattttttactcaacatttagtttttacgaaatcaatgatccgtttaccatattatctggtaccgtaattaattgcacctgaccgtcgtgttctgctgacagtaacatgccttggctcatttcaccacgaagcttccgtggctttaagttaccaacgatgataaccttcttgccaatcagttcttccggttctggataccacttagcaatacctgaaaggatttggcgatgatcagcatctcctgcatctaaacggaattgtaggagtttgtcagcccctttcaatttctgcaccgtaatgacttcagcaactttcaattcgaccttgtcaaaatcatcaatggtaatcgctggtttagtgaggttcaaattagtctcagctgggttccagccttgttcgacttcagcttcatgtttcgcgttttccatggctttacgccccttctgtttgtcggatttcgtcatcttacccttcaagaattcaacttcggcatccatatcgacccgtgggaagattggggttcccttagcaacgacttgtgcgccagccggcaaatcagccagttgtaagtcggcaattgctaaagttgctgggtccagccctaattgggtaaagatttccttaggtgcatgcgtcatgaccggactgatcaaactagcaatcacccgcaaactagctgctaaatgggccatcacactggctaacttatcagcatcattcgcatcgtcactcttagctaattgccaaggtgccgtttcatcaatatacttgttcgtccgactgaccaacttccacacttcagccagcgcatctgataaatgcaggctgtccatgcaagcgttgaagttcttaatagtcgtggcagctgtggcttctaagtcagcgtcaaattcagtcacaccggctttgaatgctggtaattgaccatcttcatatttattgatcatcgcaatggtccggttcagcaagtttcccaagtcattagccaagtcatagttaacccgcgccacaaagtcctctggtgtgaataaaccatcgttaccataaggcatggctttaactaaataataacgaagcgcatccaagccgtaacgttcaaccaatgtttcaggataaatcacgttacccttagacttggacattttgccgtccttcatcaataaccaaccatgaccaaagaccttcttaggtaatggtaacccgagtgcatgcaaaataattggccagtaaatcgtatggaagcgcacgatttctttaccaaccatttgaacatcggcaggccagaacttgttaaacaagtcttcggagtcgccggttgcgtaacccagtgccgtaatatagtttgtcagggcatcaatccacacgtaaacgacgtgcttaggatcactcttgacagggacaccccaagtaaagctcgtccgagaaacggccaagtcttccagacctggtttaataaaattattgatcatttcggtcatccgattagctggttcaataaagtcaggatgactttgataataatctaacaaccaatctgcgtacttactcatcttaaagaagtaggactgttctttaacaagttcgacttcatgaccactgggcgccttaccaccaataaccttgccgttatcatcacggaaaacttcagccagctgcgtttcagtgaagtattcttcgtcatcaacggagtaccagccttcgtactcacctaagtagatgtcaccatttttaagtaaccgatcgaaaatttcttggaccgcgcgttcatgataatcatcggtggtccgaataaacttgtcattagagatttctagcaattgccataaatccttgatttgttttgccatcccatcaacgtatgacttcggatcagtgttcaatttttctgctttttcttcaattttgaggccgtgttcatccgtcccggttaagaagtaaacatcgtaacccatcgcacgtttgtaacgtgctaaagtatcacacgcaattgtcgtgtatgaattaccgatgtgcaacttccccgaaggatagtagatcggcgtcgtaatataataagttggttttgtttctgccatgacgtaaattcccttcaaactggtttatgattaactcgttaagcatgtctttgattaaaatccatgaacaaatcacacgcgtccaaacaacacgtcttggtctaaaataacatgttgctgggccaatgtgtagaatctcttatattgtatcatatttcctgtgtttattaagaaacactaacaaaagagttctccacacgcaaagatcgtggcagactagtcaactgtgcaccatgcttcaaatggcccaaccaaccaccacaaaataaccgattaaaatcacgagttgattttaaccggtcattttgtggtaatctattattattcaacaacccacgaatatcgggccagcgcttcacgaacgacttccgcgatccggctatcgtccggccgacaccacttataatcataaacttccgagtcgactttgagcgcgccactccccgcaactaaaaaacaatttaactcgactatttttcccggttgattataggccgtaccacggtgggtgaaggcccacttaaaccgatctggcgacacaactaatgacaactcttcttttaattctcgctgcagagtctgtgttagcttctctcccacaccgaccttgccaccaggaaaataataagctgtgttttttgattcccgtgttaataagacttttccatcagcgcagaaaaccccatttgcgcaaataatatccggttgcatacccaatccgccccaatctatattgttatgacctaacattcgattctcaacaacacttcaacctgccataactatctgcaactcacatagtggcaggcaactacttagttgcttgaactgaagtcagtgtatcttaatcacgcacttttctcaatcaccctaattcacctaagaatcatgaattaaggtacttataactgcctagttttaaggcagtcccaagccatcgtatccacgaccaacgagataattattaccaaaactaaacaggaatttacataaactacttcttgactttacactaactttacttccaaatgatgtatcccaaccgttcgctttcaaatcagatggctaaggccatattgattagctaaggtgtaagtgccaaaaaatgtagcggcagctcacattattgaatgttgaatgtccgaactaccgctacatttttagttgtcatgattcatcaattaaagaatattcaaccgtacgaccaaatttcaacggttcacggtcatagtgactgtattgagccaacatagtaattcaactgataactcgttcaattaagcaaagtatcacatcaatcactcataaatcattttaaaacaagtccagttgatgcggtcctaaatcaccaaacgaaacgcctagcaactctttgagtgccatcgcgttatcggccgcgtcaccaccagaattattattaaagatgacgcaaacctcgtccgcctgctgttgtaactgttccaccgtttgcttgaattcagctagttcttgatcactataccgatataaagtccgttggctacgccagttagcgcccttggctgaccagccctgctggttacgaccatgtaagcgtaagagtgccaatttcgaattcgttacgaccggctcgaaactaacgccatcatttaaagcgtgcggctcatcgacaatcacatgggtaatccccagatccttcagaaaactaaagaccgcatctttgacactctcctcgtaccaactctggttacgaaattcgactgcgattggaacaccgggtaaccactcgaccatccgttgtaggtaatggaagttgcggttcgaccgttcaaaaaacggcggaaattggaagagcaccgcttttaattgctggtgctgcgttaacggtttgagcatcgcacggtattcccgataagctgtctttagcgcatccatcgaaaccccttcgtcataagtgtcatgcagcgtcatcacctgatttgctttcaaaataaactgaaacttatcagggacggccttttgccacttcgcgaccgtcgtcactttcggaataccatagaatggcgtgtccacttcgacgactggtaggactcccgaatattcagttaaggtcagcttttcagtaccacccagtaaactagggtgttccgtccaagttgttaagccaattgttatcatcagacctgcaccccctcgaagaagtcgaccgcatcttgttgcaccatcgtaaatgcaaatggcaactggagcggttccgcattgattgcaagcacttgagccttcggattacgatagtcaattaggccggcgaacgggtacacccgaaacgaggtcccacaaataacgactaggtcagcctgctgtaaatattgaactgcccgttcgatattggcactcgcaatcccctcgtcgtacaacaccacgttaggccgtaagtagccatggtctgtctgatggtaaggagacttcaaatactcatgccaatcgacatgctgaccacacttggtgcagtagacctgatagagattaccgtgaaattcaacgagctgagccgttttagccaccccatataaattatcaatattttgtgtaatcacactggcccgcccttgctgagtcagtgccgccatcttttgatgaatcacattcggttgggcgtctggatagtataaatttgattgtaaatattgataaaattccagcggatgctccgccaaaaacgcgtggcttaaataatactccgcgttatggtgttcggtatacagtccatttttagaccggtaatcaggaattcccgagggcgtcgaaacgccggcccccgtcataaaaacgatatgctgagcttgttgtaaagttgtttgtgctgctataatgtcactcattctgacatctccctgcttagcttaccgtaacgtatagggtagattcatttcttggaataattctttgaccgtcttatcgtacacctctttgaaaaaggcatcgctcttcttttgcgccggtgctggtaggacaaacgcattctgacggtcactcttatataacccaatgtacgctcgggtatgtttatttttatctaatagatctgaatggtaaacgtcaaataactgccggacttccagccgctcttgccgttcactgagcacactctgaacggtcacaaattccgttccgtgtaggactggtaaatgccaagccgtcatctgatcatcaaaagccttgaacagctttactacggcacgccgcatagcgaacggggtgtcaactggcttctgactgattacggtgtatagcttctgtgcagccggccaagcttgtggataggccgttgtcaccttttgcaaatcatcagctggtaattcaccattaaagaaaacgagtaggtcagtcaatgttaataaccgtaacgtcatcatcgcatccgccttgcccgcaggttccggttcgattgtggccgccacaccttgcatgtatagcgtttcaatttgctcatcgattaagttatgttcccgttgtttgcgtacgaccaagacgtggctcaccatgtcataaagttccatagcgattgccatcaattgttcgtccagttgttgatcacgcgtggttaaattaaaggtaatctgtggaaagccttgtaataacaataatagatgtaataattcatgtgacgctgtgtaattaggagccgtaatatcgctaacccgaacggtcaggtcaccatcatctaacacttgttgtgcttgatcatggcggacgtaacccgcttttgtgtcaccaaaacgaacactaatattgcccggatataacgaattggcggtacttaataaatctgtaacagtttggttcaatttaatttcagtcatcagtctcttcctttgtttgccgcaattccgcaatgagttgttgcgtggttgcgagatcttgttgagatgctaattcaagtcgttgtaagataacggggagttcctcaggagtcgctcccgctgccatcgcgagcgatttcaactgtaggtgcatatggccctgctggataccagtcgtgaccaaggcgcgtaaagcggctagattttgggctaacccgatggcaaccataattctttccaaatcacccgctgtttgaatacctaatattcgttgattcaactgggctaactcgttaattttgattgaaccgcccacaatgccaaccggtagtggcaattccagttcaccatgcagcatccgaccatcactggtccaggtactcatgccacgatattgaccgtccttaacagcataggcgtgtgccccactctccaaagcgcgccagtcgttgccactagcaatagcgacagcatcaataccgttcatgatacctttattatgagtcgtggcccggtacggatcaagctgagcgaccgtgctggccgacgcaatcttctgggcaactagtttgccggcataccgcccagcctgtaataatccgaccggaatgtcacaaatggccttgactaagctcgccgttgcataattcgatagaatactcattaaagcgtcctgcttcgtcatcacaccgatggactttgccacggcttccaacatactattgagcatattggcccccatagcagcctgcacatcaacgaataggtcaattgataaatagccttgtccgagaacacgcgtacgtaggcgccgagcgccaccacctcgtttttttaaactgggatgggccgcatcagctacttttaataatgttgcagcgtgggcttcaatcacggcagcggttgcagccggatcagacaactgctccagaacgatttgaccaatcatttcacgttgattaaggacggtcgtgaagccccctgcacgcttgacaattttagcgccattacttgctgccgcaataacagaaggttcctcagtaaccattggaacaatgtgatccacgccatcgacgactaagttgacagccaaccccatcggtaatgggtaatccgtcaaataattctcaataatttcatgatgttgtggtaaataatattgtttaaataacgcctgttcagctggcgttaaatgggcctgttgcgctacgatggcagtgcgttccgcccaatttttttgataaaagtgccgaaaatcagctgtcatattctcattcctattctctccattcgactcatctaccgaaccgacctattgattgaggtgttctgaaataattccctcacgaacaccactttcagaaaagatcacccgatcactatccaacatctgtaataacgtcactagcggtaacattccaccaacaataatgtccgcacgatcatattccattcctgaaatttcctggcgaccttttttcgaccgtgacagtaagtccaaaaacgtgtggaacaccgtctctgtcttcagacgatacccgtgaatatcttcaacttttaacttttgttgccggcgccgattaatgcgggctaaggttcggttggcaccacccaatagaatgattgggaagtgcactgcttctgataaccaccaaatatctgccagtcggttacgtaggaacatctgcgcccgaaatagactcgcagacggcactaagtcgtcgagaccgaattgttccgataatgtcaccgcgccaaatggaatgctgatcagttgctgtttgcggccatttttgaccaagatcagttcacaacttgcgccacccgtgtctaagattaggcaatcatggatgaccaatgaattggcaaccccaagataatcgtaataggcctcatcgtcaccagataagactcgtaaatcgagccccacttcttgcttgacttgattgagaaattcagcctgattttgtgccatccgaactgcagctgtggtgatgccaataacatccgtattgggcattttttcataaagtcggcgaaaattgagtaacgccttgattgttcgctcaattgcggcgggctggagtacgtgtgccgttcccattccttccgacaaacgcgtatcttccttaacacgcttgatttcttgagcagtgccgttagcatgcaaccgactgaccgccatccgcgccgaattggaccctaaatccacaatcgctaagtttctcataacaccacgctcacttttcgtttataaaatattagttaggtttattctaacatttatgatgtaacactgtgacttctagggccggattgcacaccaaaaaatatcaaaaagcccaaaatgaacgacgctagtgttttgactagggccgttcattttgggttcattagactagctagttggcagtaacgatcggagaactcgaacaacttcgtcccggtttaagtcaaaatcgggatctgatttaaatcgttttttgaatatttgctcgggctctgcttcaaccagctgaataaaactttttaaatcattctgacaagtccttggtacgacctttgagtcgaacgtttgattctcaataatcaaatcacacaaccggcagacatccttataatgtttgttcttattagcacgatgacgtaatttatcaccatttgctaaccgttgccgaatatcaagatgagctttggctttaaagtagatcaatccgggtacgcttaagatagaaacatggccaatcttttgctggcattgcttcaacaagctatagtaatcatcatttaatacaatcgccgacaaactagggcccgttgcaaaatgtaacggcattgtctctgtcggtaatctaagttcatagcgcaatggtatctttgaaaacaattcaatctgttgggggacgcccgtgaccgcaagtgcaggatctaacgcaaaccggtaatacactttcttcttattcacatcaccccctatctcagcacacaagtagccatatttctcgataaagtcatcaaacttttgtgaaaagcccagttgactattttcaaatatgacgaccatatcgtaatcctgggtcgctctaaaatcctgatgatcttgcgctaaccaaattgcggcagcattgccaccaataataacgtaacaatcttcatagccttcgaaaaagtcaaagaacttgtgaaatagcatcaccttatgctccgttccaaatttgatcaaccaattcttcggcttcgccttgagtccgctcgtccatatcatttctaaatagtacgtataaatgaaagggatccaacacattcttaggataattggcaattagtctaaacaatgtgttaaaaccgctgagctgatactttgaaacttgcacctcacaagcgactttccgctcatcggtatctgcgtcaaccgttgtcctcaaggtttgccgtcgagaacggtccataataactgtctgttgcttccgattatcactgatcatcgtcactttagataaaccagtaaggccggaataaagaaaattcttactagctgattcaactgatgctttcgccaactgcaccaagtcaacagattgaactggcgacactaagaatggcgctatctgatcaaaaaaacggcggctatctaactcgcaagtatagacgcgctccttagtctcgccgattgacttcagccaaccatgtgcaactaacggtttaaccgctcgactaaaggtaactcgattattgatgctaacttgcttgccaatcgttgatgcaaagcattgtccgcttttgatcaagaaacggtcatcagtcgttctgaaggctgctaactcgggacatactttggccttctctggatgacgttcaaaaatcaactgtgctaatacgatggttaatgctagtcgttgtgccgcggaggctaaaggattgcccgctattccaggtgagtcattcacggcttcaggtaataaccgtgtccccataaacggcaaaaacatttcaccatctgatgtcataaatggcattctgtttttcaaatattcgtgacgctcattggcggaaagctgaggaaaaataaacaccaatgggtctcgatttacctgactaactcgtgcatagagccctagtggccgcaaatcgcgctgaccaccataagacataaaaaggaccggcttatcaaggattgtcccctgcacaaccaccgtattattttgatccgaacgactcaacgacaatttcgacgttgaaaccgattcgccaatagttaccgggatacccgtactttgactaatatattctagttggttaacaagctttatcacattcttcgccccctccatccaaatgattgtaacatgttttcttcgattgtaacgcagtaatgttacaattgttttaaatgatgttacaatcatcctaattagctgagctacaagcaaaaattaacactatcacgtgaccgaaacttgttattgagcacctcctcattaatcagatagacacggcaatcgtccgtaattactccgctagtcattgccatcagtcattatttacgtcaattgacgcctgttccacttaaaagtgactaagtttttttctaaaaaaacgtcgaattgaacagctgttggaccaactcctaacaagggcctaaatttgaatacaattgtcatacccctttagatacaaaaacatcccaacattagcactcactgccgatatcgagatgtttctatataataagtattgaagtttattaacgtattactgccttaatcaacctgtctgctgctgacactaactgtgattggtcacccgcattttggcttgataagccgctaaaattttgcgtacatcatccgttgacttggcatccatcatcgtgttacgcaggtcagtagcgcctagttctgggcgcgcatagattttaaagaaccgttttaaggacggaaaacgtggcacgtcataacgggtggcaaagtcatcgaacaagtcgagctgcatgttcagtaaacccaatagttcatgcaaatcatgcgattggggctgggactcaaacgcaaacggattcgcgaacactccccgaccaatcatgataccatctaatccaggatgtgctttggctaacgccaccccggcctgataatcagccacgtcaccattaatctggagtaacgtttccggggcgatcgcatcacgcattttaatcaagtcatcgataacttcaaagtgtgcgggtaccttactcatttcctgtttggtccgcaagtgaacggtcaagactgccacatgttgcgataacaacgttgcaatccagtcatgatattcagcaactttactgtaacctaagcgcgtcttcgcactaacggccagtcccgacgtctttgcagccgcaatcacgtcttcagcccactgcggattgcgaatcaaatcgctgccaccatgatttttgatgaccgtcccatccgggcagcccatattgatatcaactgcttcaaagccccggtcacgaagttcagctgtagccgaagcaaagtcagccgcttcgttaccccacagttgaacgaccggtttttgcgactcagctgccgccacgtacaaacgaccatgcaccggaaacttcgtattcgggttcgtaatactcttagcatagacgaattcactaaaaaacgtatctggagcagcggcatggctaatgacttgccgaaaaacagtattactaacggcttccatcggggccatcgtaaaaaatggtcgcccgtctgccttggcttgggccgcaatttgcgaccagaatggtgttgctgtcacgttctcatactcccttatcactagtttaacttttggattgaatgcttttaattttagcattgatatgcctgctttgcaggaatgacgtttgctggctaaataaattaaaagtttactcaaaccggtgttggacgacttcttgatgacgaagttcccgtaacagtgcctcaataatgtaaaggcatggcacttgactagttaagtcataatattgatgaatacgctcctcagtcgcccgatacgttaacgcatatcgactcattcgagcaatcgtactctcaagattactcgtaatactaataatattgacttcaggattattcacaaagtcattaagcatttcaaccaactcagacgtctgaccggagactgacactgccaccaaaacgttattactagtattacgtaattgtggtaatagtggatagaaaggatccttgacgacataactattaaatcctaatgatgacgtttgacgtgaagcatactcgcccaacgccgctgatgctccgataccaacaaacacgatattatccgcattgaccatcaactgagctgccagtcgaataatcttagtaatatctgcaggaaaggcactcggttgaacaaactgaatacctggagcatccggcttttgaatgggcgtttcactgcgtagcgatactttaaattctggaaaactatcatacccaattttacgaataaagcgcatgactgacgaattagaaacgtgcgcaccccgcgctaactcacggactcgcatatacgggatttgctcatcatgctccacaataaatcgataaattgctaaatctactccagataacttatcgatatccttatagccaaagaatgccacggttagccaccaccctatctaataatctattcactagattaccataaatgcgtaaccgcttctaaaaaacatctagcattcaagctttttcattttttaaattaaaatacgtgtcaccctattttaataaaccagtttgatccgcctttttaaccacgcttaatcaactgatacactgccccaatcatcccagcatcattccgcaatttagctggtactactgatgccaaagtcaaatgattaatactattatgattagcctgtaagtctgcaatcgttgcattcaaatcagtcataaaggtcgtgttcgcactaatgccaccaccaattacgactaattcgggatcaaaagcaaccattaaattaatgattcctttagccaaactgtaatagtagctatgaaagacatgttgtgccagcacttctcccgcatctgctcggtcaaaaatctcgcgcgcgtcagtaaccggcatcgcactaaactgattataacgtcgtatgagaccgataactgttgcaccccggaaattaagggttcccatttcagtatcaatctcatcatcgtcaacaaccatccaaccaaattcgcctgaacgcgcgtgtgcaccccgataaatctgattattgataaccagtgccccaccgaccccggttccaagaaccaagcttaaataattaggcacattctgagctactcccagccattgctcagcaatagccgctgcgttggcatcattttcaataatgaccggtaactgcgtctgtgcatgtaactcagcttgcaagttaattttttcaaacgccgtgaccgcacctgccgtcgtcaagaagccgtcactttgaacaactcccggcatgctaactccaataccagcaacttgtccatctgcttgtagtccttgaatcatcgcaactaaatcggccataatgtctacctttgctgtggcagtcggtcgtgttactttacgactaatatgtccatgagcatcaactaggccgcacttgattgaagtaccaccaatatcaattccaatatacattgtcatttaacagtcctcctaaacgcccaatggccagctatcaaagctggccattgacaactatttcaaacatcattaattaagcactagtcaataattaatgaccatcgtcatacccaaatcgcactactcaatttcggcaccatttgtcgcaatcacatgttgaaaccaagtaaatgaatcctttttataacgttttagactacctgaaccatcatcgttctcatcaacatagataaacccatagcgtttggacatttgaccagtactagccgcaactaaatcaatgcacccccatggcgtatacccaattaaatcaaccccatcttccagaactgccagcttaatttgtcgtaaatgatccgttaaatagtcaatccgataatcgtcatgtatctggttatctgccgtcttcttatcaattgcgcctaaaccgttttccacgataaacagtggcaaatggtaacgatccgtgaaccaattcatagcatagcgtaacccaacgggatcaacttgccagccccaatcactagccttaacatatggatttttaactaaatcatgttcttcattataagctagctttcctgtgtccttcacagtaaacgacatgtaatagctaaatccaatataatctaccgttccagcttgcaagattttcaaatcttctgccgtaatgtccaagttaaaatgctccgactcaaaacgattacgcaaccattgtgggtaagtgccattgcaatgaacatcggcaaaataaaatcgggtttgcatcgctcgttgcgcaaataagacgtctgctggtgctgctgtaagcggatagatcggacacatcgcaatcatacaaccgatttgaaaatctggattaatctgatggcctaactgtaccgccgcggcactcgccaccagttcatagtgagccgcctgatacatccagcgttcacggttttctcctggttgatgaatgattccagaatctgttaacatggcaccgtctgattcaaaattagtttgattgttgatttcattaaaagtcatccagtacgttactttatctcgataacgttcaaaacatacttttgcaaagtttaaatagaattgaataagcttacgattacgccacccaccgtattgcttaactaagtgatatggcatttcaaagtgtgctagtgtcactactggttgaatcccatttttaaggcattcatcaaataaatcatcataaaattgtaatccagcttcattcggttcgctttcatcaccattggggaagatccgcgtccaggcaatcgatgttcgaaaacacttaaaccccatttcagcaaacaattcaatatcttcgggataacgatgataaaaatcaattgcctgatgattaggataatacttgccagccactactccgtccgtaatttcacgagggcgctcattcgtccctaatgtcataatatctgccgtactgagacccttgccgccctctttataaccaccttcgagttgatgtgcagccactgcgccaccccataagaacccttctggaaacgctcgtcctttaatcgtcatgttaaactccttttaaactatgctttaaccgtttctgtcgtcgtatccgtatcttgtttagattgactatctgcagccatcatcttattggcagcgagtacaaatggtatgtacgtcaacacggaaattcccaaacaaacaaatccaataatcaggccaagccaattgccaccagtccccaagaacggcatcagtggtcccggtgttgtccatgtcaatccaaaagccggcgtcggtatccagttaaaaataactgtcactgtatagccaaccaagatattgatcactggtgttagaacgaatggaatcgccataattggattcaaaacaattggtaaaccgaacattagcggttcgttaatattgaagaggccgggcactaatgccaatttagcaatctcacgataatctttacgccttgagacgaggaagatagcaataatcaagccaagtgtcatcccactaccacccatattggcgaagacatcattcaacacactccaggttgcacggttgggcacaccccaagctgtaccatgagcgttaataaacgtttggtttttcaaatcagcttcagtaaaaataattgatcgtaacgcgttcaacgtgtttggaccatggataccgacaagccacaaaagattttgaacaatagcaataatgataacgccaaataagttgaccccaatgtgggttaatggtgtttgaattgatttataaataatatcattgattccttgtggtgaaattagtgataacccatagttcaacatagaaaacagcataatcataataacgataggaattaagccattgaaagaccgtgcaactgccggcggaaccatctcaggcattttgatttgcattttcttaatgcgcgttagccgtggtaaaaattctccaactaagccacctactatcattgcaacaaacagcccttgtgcacctaaataagtcgttggcaaataggttacaccgtctttgataattgatggtgagtataaaatcatgaagcaggcaatccccgtcatccctactaacatgtcatcagctttaaaatatttggccaaattccgtgccaccagatacgcaataaaaatcgataaaatattcatcgttccgttagttactgaggttaataacttttgggcattttccaagtgtggaaaaaaatttgggtaaaaataagatttgtgcaataaaccccgtttttgaaaaaactaagttattaattaaaataactaacgatgcagccattgtaattgggaatgtgtacataaaagcatcacggattgccgcgacatgtcgctgttcattcaacttgactgcaaatggtacaatgtgtttttccataaacacgttaaaaccgttcatcataagttgttcctccctttgatttaacttacaaaagctagtataagtgaactacatgcgttttaaaagcgcttacaatgcagttgctcacttgttccatcgtgatggtatcacgaccacatctgaaacgctgtgtaccatatctgttcaaaaaagtactgtaaatccacttacggatttacagcactcttctaacgaaatcaatttttgaatccagcctgcttattgattataactagcagccatctgattcatcatcttcttaaagcggcgtttacggaaccatcctaagaatagcacgccaagcttattattggcattcgtcttcttatccttgcctaaaaaggtttcggcatattctaagacagtttggtgaccatcagtgtccggtgcgaattgataatcgacgccgtaatgatcgcggggcgtttctaattcatacgcatatcgaacaccgggttgcgcgtgggtaatcttcaaattaccggtcagaccgttggaccactgtttggcatactcatagccttgtaagctctgccgtggcgccgaccgacccgtttgctgctgaatatcagcccgcgcggaatcgatcaactgttggtataaataatccacaggggcgttcaaagttaatttaatctgcattctggtggctcctttctatctgacccactcgccgataaacgacgaaaagtgctgcgctgaccgctaaacctaatccgagcgtcacccattgaccggtcgttccggccaggggacttaagataacggctaataatccaaggttcatcccgatgagtaaacactgctttaagcttttcatgacaatctattctccaatcgctgctggtttaatcttgttggcagccttaacgaatggcacgtaaatcgcaaaggcaacggcggcattaaataattgtaagaccactgaccgccagtccattgtggcaactaaggcgttcataatcggtggcattgaccaaacgatattgttcgtaatcggtgcgacccacccagctgataaagcagcgtaggcgatcgaaacagtcacaactggtgctaaaacgaacggaataaagtagattgggtcaagtacaattggcatcccgaacatcacgggttcgttaatattaaagaatccggggccaatcgccaacttagccactgaacgttggtcgtctcgtttactaaatactaaaatcgctactaataatagtaaggtcgagccggccccaccaatccatgcatataagtcaaaacagttccgcgtccaaacgtatggcaaggctttgccagcttggtaagcgttaacattagcaagctgagccgtcaaccagattccgtccaagattggtgccaggacattggaaccatgaatcccgaagaaccagaaaacttgaactaacagcgtcattaagaggacggcgccgtacccttgactcatattcaatagtggttcttgaataatcttcgcgatccattcaatcaccgtggtgttgaatttactgaagatccagttaataatcccaacgacataaaatgcagcggcggctgggataaccccagtgaaggcgtttgcaactgccggtggcacagaatctggcatcttgattgtaatgtgtttcttcatcaaagcaatgtaaacggcactcgcaatggcccctaaaatcatgaccgtaaagaaaccatacgaaccaaagtacgtgttgaagttgaagtaaccccaagccgtcacctttttgccagcaaccgccatgccagagtccgtcaaaatcttagtagcgcccttgctcaacgtactcgtcaacgtgccggtaaagttttgtggcaaactcatgatgaaagttccaagtgtcacgatcccaccagtaactggttcaactttgtactggattgccaattgatacccgaatgtaaatgagaaaatcagacctaagatggctaacgtccccgtccaaaccatcgcattaattccaatcaaccactgcatcgaattaacaatgcccatccaaccgaacttcgttggaatatctcgaactaaagcgttcagaaccgtggcgatcgacccggccatcattgccggcataattgctataaacgcgtcacgtaatgcgatcaaccaccgaactgcaccaatcttggccgcaactggcactaagtgtttgttaagccattcgataaatgaattcataatatacccctcactcctaatgtaggttttcgctagttagtgacccaacacaactgttgcgtcacccccgtactagttttgtaaatcaatattttcggtatggtagtagagttctaaatctggatagacgaagaacgtcctggagaagttaaagaccgtcccattagccaagtaattgattgcttccaagcacaacgttttgtcaccatctgggcaaccgatcaactccgcccgttgcgcgtccacccgcacttgatggacgtagttttccgtggtgctccccgtaataccatatgcctctcgcaagaaggcgaagattgaatgctgcacgctctcactcgataagaacgggacgaccgttcgcggaaaataagactcttccaggtcatacaagatgtcattcaaataacgtaatcgcaccacccgataaacctcgtcgccaagcgcaatgttcccttgttgtgctaaagtttcatccgctgtcactttatcaaacgtgacaacttttgatactaatggtccaccctcaaccatggcggactggtcaaatccaatcgataagttgagcactttcttcgtgttctgcggttgtttgataataaaattgccgctcccctgcacacgacgcaacaacccatgccgaaagaccacatcaatcgctttacgaatcgtattgcgactggcgttgtactgcgccattaacactttttcggttggtaacttagtcggatattcatccgccattatcgatttaatgattgcctgcgcaattgcctgatacatgactaaacctcctttcgataaattagtaggtgcttgtaaaacttgtgcccacaaattatattatcacagaatatatgaaaacgctttatttttcgtaattttataccaatgaatttatattatgactaaaggcagccacagcaagcgctttcgaattccttaccaccccttttcttgccaaaaacttattttaacaagcacttttttacaatcattcatgtaagaaagcaaacgaaatcagcctaattttcaatttagtctgccttttctttttaattcgcaaccgtgatgcgttgggccatcgttattaatttaccggaaagccccatatattaagggtctacaaaaaagtgcaactcaccgtcttcacacatccgacggtcagttgcacttttttctaccatgatttatttaaaataattaattccaatggcgtcttgcatctcacgccacgtttggtcagcgaccacgttcgctttcgctgtaccatccttcaaaatttgtaagacttgagctggatcagcttcgtaaattgcacgccgttcgcggattggccgcaatacaccgtccaacacgtccatcaagtagcgtttaatcttaacgtcacccaagccaccatgttggtaggcggccttcaagtctgcgaccttggccttgtcttcatcgaaaatatcaagatacgtgaagaccacgttaccttcgaccttacccggatcttcaatatgaatatgatcaggatcggtatacatggacatgactttcttcttcaaagtatcggcatcgtcagaaaggtaaatcgcatttcctagtgatttactcattttggcattgccgtcaagtccagggattcggcccaagccctttggtgggaagtagccttcaggttcgaccaacgtgtcagtttggtaagtcttattgaagctccgtacgatttcacgggtctgttcgagcattggttcttgatcgtcaccaacgggaacggtcgtcgccttgaaagccgtaatatcagcggcctgactgactggataaacaaagaaaccggcaggaacactttcaccaaaagctttttgcttgatttccgtcttcacagttgggttacgattcaagcgcgctaccgtcactaagttcaagtattgattcatcatgtcagttaatgctggaatttgagactggactaagatcgttgacttttggggatcgattcccactgccaagtagtccatcgcaacttgtaataaacttttacgaattttttcgggatcatgcgcattatccgtcaacgcctggttatccgcaatcataatatatgagtcatagtccccagaatcttgtaatgcgacccggttacgtaatgaaccgacatagtgcccgatatgcagcttaccagtggggcgatcacccgttaaaatcactttttttgtcattgtattcatcctttctattggcactaaaaaagcgcctgatcaactaatactagttaattaggacgcatcaccgtggtaccacctaaattgcagaaagcttgtctctgccactcattgaccgataagggtgggtccccggtgttcaccgaatctccaaaaagccaattcattagtccgccccagctttcagcacgcgctaggtctctgttattggacgccttactgttcttttcttcaacgattaattagttctagtgtactggttatacctgaccgtgtcaaaataaattctgggcatcattcgcgctaactagccgctaccatttcatcataccgaccgtcatttccacgtttaagcccatcgaaattcaagcgggcgttccttcaacaccattaaaattcagttaagtgctcccagccccagtccccatttacgcttcagtataattccgggcgccggtcttcaaacactggaatctgaccacgaacctggtcaacttgtgttaaatcaagctcggccgtaatcaactgggcatgggcaccaccgatagccacaatttggccgagcggatcaataactagtgactgaccaccaaattgattatcaggatcactgccaacgcggttaaccgcaaccacgaatgcttgattttcaatcgcacgtgcttgcagtaatagccgccattgcatctgccgcactgtcggccactcagcactgacaaaaatcacttgggggccacgagctgcttgtttacgaagccattctgggaaacgaatgtcataacaaattgcccccatcgcaacagttccgtcgagttcaaaaacattctcggtctcaccagcggtaatataacgatcttccgccattaacccaaaccggtggactttatcgtaacgactcagtaactgtccctgacgatcgacgactaacatctcattatagtaatgcccatcgcgagcgaccgcgactgagccaccgacaatgttgacgcgacactgccgagctaacttgctgagtaattgtaacgttcgctgcccatcatcatccgccaagacattcaggcgagttaacgcataaccggtattccacatctccggtaagacgatcacgtcaacagtttgttcagctgcccgttgaatggccacttcaatctgctcgtagttggcatccggatctccaaactgaatattaagttgtgctagtgcgacacgcattcgttccacccactttattagaatgattaaaatcatattagaataaatagtcagaggttgcaagtttcagccttgccatcgtaaggctgccgaacttgcccaccgttggctagcacgccttagtgccactcataatcacatttcacaacaattactgataaatcagtgaatttgcaggcgctttgattgacatcatccctaaacccgcctaaaattgttcaagcgatttagacgattatcagacgggaggccctctacgtggcaacatcagatcaagagcaacaacgcgaacaacaacgggttgatcgagtcatcgagcaagttaaagaacgggcacaacagaccgacgacttgctggcaaaggctcatcacgaaaccgatgtcattcagaaaaactatggtgataataattccgtcaacacgtttgaagtcgatgaccggattgaaacgaacgcggaactgcaacaacaaaagcaaatggttgaacgcgccgtggaatccgaagccatcttgaaacggcaagtcggtgtcttgaaagatcttagtaactcaccctattttgggcgcattgatattcaagatagtcccgacgaggaagccgaacgtttatacattggcaccgcctcatttgtcgacgctgaacagaatttcttagtttacgactggcgcgccccgatttcctcagtctactacaatggtactctgggccaggtccagtaccaaacgccggccgggcaacagacgaccgagctgatcaagaaacgccaattccagattaatcatggtcagatcaagaatatgttcgacacgaatgaaacggtcggtgacgaaatcttgcaggccgtccttggagaacaaaatgatgcctacatgcaaaatattgtagcaaccattcaaaaagaacagaacgatattattcgtgacaccactagtgacttactagttgtccaaggggtcgccggctctggaaagacgtccgccattttacaacggatcgcttttctgctctaccactcacgggcttccctagaagcggaccaaatggtattattctcacccaaccgcttattcagtcactacatctccgaagtcttacctagtttaggggagcgcaatatgcgtcaagtcacgcttgccgaatttctcagtgcacgttttcaaggcctaaccgttgaaagcctcttcgagcgctacgaaagtgaccgccagcgcgaacaactgacaccggcaattcgcgattttcaagaaagcgccgactttatgcgccaagttgatcaatattgccatcagctaccagccgaccaattacgcttcaccaacatcgtctttaatggcgaaatcttcttcgctaaagaggtcattacaaagattgcggcggccttaccagcagcgatgcaaccagctgaccgtttcttagcaatcaagaacactttgattaaacgcttaaagcatcgcattgacgatgaagcccaagctgactgggtcaatgatattattgaccaattgagcgacgaagcttaccacgacttattaggttccaagcgccggggtgattttcaatcactcgacgatgaagtcttctatattggtaagcaaatcgtgaccaaacgactgcggcaagtctacgatgcgatctataatggttacttcttagacacctatgaacaatataacgatttcttagcgcaagttgatcggcccaccaccgtgacgcctgaccaatggcaacaacgaattgccgcttaccaggccgccgttgagtaccatcggattgctctggttgactgcgcgccactattgttattacgcgatgtcctaactggcagtggtcagaaccgacggatgcaatatatctttgtcgatgagatgcaagactattcgctagcacaactgttatatatcaagcacgcgttcccactagctaagttcacactgttaggtgacagtgaacaagcattattcaaggggattgagttaccacagcaattactggaacgcctcaaggatgctttcaatgtccgacgggcgaacttgattacgttgaataagagctaccgttcgaccgaacagattacgaactttgctaaagcgctattacccgacggcgaccagattcaagcgttcacacgtaaaggcgatttacctaaagtcatgattcgctatggcgaagacgccgctctcagcagtctgcgtagcgaagttgaacatcagctcaaggcaactaacaccgttgccgtactaactaaagatttagcagaaagcaagcaggtctaccaatacctgaaacgctatacagtaacaacgttgatggccgatagcgaccgtaccatgccacaaggcgtgattgtcatgccaatctaccttgcaaaggggctagaatttgacgcggtggtcgcatacgatgtctccgctaccaattatcccgatgcggattcagttggcatcttatatacgattgcgtcacgagcgatgcaccacttgacattgctcagcatcggtgatgtctccccactaattgcccagttggacccgacattatttacgattgaacatcaggtacgagtataactgtaataaaaaaacgactggaagtagcccagcggtattacgctagctacttccagtcgtttttcgttatcacgaaactaatgcttgaccatttttctcacgaccagttaacccagtagtgaaagtacaattaaccaactcaatgattatcaacaggtggataatacaaacgccactgctttatccacctgttgataaccttaaaatttaagatctgctgcttatcagtttaggttatatttgcaaaaaccgtagtacgctaccaagcaactacggtctacgtccttatttaactgacttgatacttttttatctgtgcatattcagcaccatgtatctgtttcaaattacgaatttcaatatcattttgaagttccaagaaataacgatccgacactccaaagaatcgtcctagccgcagcgatgtatcaaccgtcacctgtcgacgatcatgtagtaagtcttgaatccgtgacgtgggtaccccaatctgttgagccaaaaaatatgcagagatatgcaagggagccataaactcttcttcaagaatttcactaattttaggtgttgggatttcattcattttttggtctcctaaccatgatgataatcgactatttcaacatcataaaactcattaccatttcgaattgcaaaacatatccgatactgattattaatcctgatgctatattgcccttggcgatcatgacttaatttttccaagtgattggcaggcggtaggctcaaatcattaattgtttccgcatgatcaatcattagtaattttcgcaatgctaattgctgaatggttggtggcaattgtttagagaatttttgttggtaaaccttgtgagtttccttatctgcaaaattcttaatcgattatacccgtatcacgtgtatatctcaatccatccgactcttgctcctattattagctgaccacacccaaatatccaattcatctgagtacccgactagtacgacccctattttagctaggaaccaaccagagtatccccatatttgctaacatatgtgtcacgctattcacacgaatatcatgcttagataataggtagatggtccccagcaccatgccgaacagcgtgtaatatgctaatggcaccaagctatttccgctatgcagataaccgaaaagaagcccattgataacaatggtagccgcttggtactcccggccaagatattggtctgacaagacgtaactaaagaaaaagcccctgaaactcagctcctcagcgattggtccaaaaatgacggcatcgagtgtcatcgctaccggatttttccgcaacagtaaatctaatgcacgttcattacccgattcagtgatgtgccataccgccgtcagcttagcatagccaaaagcaagcgccacgataatgactgcgccgatcaccatgagtagcaaggctcgtttatttagccgcgctcgccacggtcgaaaatcaaattgccgtaattccgcggtcgtcttatagatgttgtacaagaaaacgataatcacggcatataaactgaagctaactaacagtgtaaaccaattggccgtaatcaagtaaatatacacgggtaaggaactgatattgacaataatgacactcagcacactcacagttagtaaattaccaataaaccgtaaattcttctgtaacatttcatccactccatccaaacaaccgtaactagaacgttcactaacgggcttttaaatcaacccactcaagttacttgccaagtccatttggcctcatgccattagcatgaggctcagattagctgtgacgtgtacgacactgttgactcgaatatcccggccagataatatgtaggttgccgcgagtacgagacccataatcgtatagtatgacaactgcacccaactaaaaccgccacgcagtagaccaaacaacacgccgttaacaataacggtaactagttggtagcgtggctgatcaaaacgttccgccagcgcataactgaagaaattgccgcgaataattaattcctcgcaaatcggtgcaaaaacacccagggccaacgccatcaatatcggtgagcgctgagacaatgcttgtaagtcagcaacattctccgcgattggatagacagcgtcactaacaaatttaacttgcaccgctgccaagatcagcatgaccaccattgccagtaccgtaaccactaaccgacgcgcgctcggcttagcagttattttcgtaatcctaaaatgattattagtaactgattccagataaattcgatagaataaataaattgcaaacaggtagacgaccaagaagatcgccaccgttatccagttatacttgagtgttagaatatcgatgggcgccgtactaagacccatcacgattgctgccaataaactggcaagtagtaatctaccaataaatttgacgttttgatgtaccatgctccttcacatccatttcttgataattatccccaatggtacctaatccacaacttgcggtttgaccggatatcactaactgaaacttatccccacatcatgttaataattgtgaccagccagttcaccagtatatgacatcccattgcggtactcagttgttttgttttgagtactaaccatgaaaaaccgcaccctgtaatgaagatgcccaccgtactggctaactgataaccatggccgagcgcgaatactgcgtttgtcagcataatcgcgcccaatactggcaagtatcgtcgcagcgtattttgaacaattccacggaaaagtaattcttcgagtacggggctaacgatgtttgtgcacactaatgttaatagccccaatggactgtggatcagtgccatgatttcatcattttgtgtttcagttggactgactagcagaccacttatccccatttgaatcaccacgaccaccactgccactaaagcagtcagccccatcattgaccaagaaaaaggccctaccaggactggcatctcaaaataatggtgatagcaacgtactagtacgaccgcaacaccaacggttaaaacgactaatgctacccaatgataaccgacgttgatttgttgcgagcgttcaccccaccaattccaatagccatccgctaacaccggtaattgaatgaatataaatagccctaaacccgttaacacataaccaaataccctgagcaatcgagcaaccataccaagcctcccaagttatcccctgtggataaactaattcttatgttttaatttttatccacagcgttaactcatagccgccaacgcgaaaactgccaaattagtccccatgtgcaccagaatattcattctaatatcgcgcttagccaacaaataggttatccccaagatgctccccattaacgtataataaatccacggctcccaatttgcatcaacatggacacttgcaaatattaagctattaataacaaccgcgatcatctgataattacggtgattatactgattcgttaacgcgtagctgaaaaagataccgcgaaaaatcaattcctcacagatgggggaaaatatcacgacagaaacaatcatgggaagcggtgcttcaccgagcatccatgccaacgacctggaattgctggtctcgggaatatttagcatcgcgctcaatttaagatcaacaataatgagcacgaccattgtcagcatcgcaataatcacagcccctaattgtgcaatgttcacccgggacttcaccgtcgcgacttggtaatgcctaactcgtgctgtatgccgataaagccaatatagcccccaagcttccaagacatagattacaaaaccaatcgtgatcatgagccaattattcttaattaggaaaagatacgccggtgccatactaaaactcaccaatgctaagctgattagactggcaatgactaggttaatgatgaattgtctatttgagtgtgccattacttacctcttccgtatgatatatgtgcttctagataactttactttaccacagtgatatttagtcagttagtactgatggtccaccatcaattattatccagcaccttatctttataataatcaaaccaagtcaccttgcccgtaataatcgccgtttgcccaatcatcccgtagcgtagtaactgtgcctgatcggctgtaatcggaacggccgctgtcacttcataaaaagtcgctttactctcctcgactggtgagaccccaatctttgtaaccacaccatccaaaatgattggcttcggtacgttccgcgtgactttgaatctaatggcttgcttgactttaacggaagaaatatccgccgtcgaaatatatagcttaacgttcactcgccgttgttgcttgattatcggtaaaattttagcgatttcagctcctgaactaacgtactttgcaccacgataattgtctgcaacgtgtaggacgccggttttggttgccttgatcgtgtaagattttgattgtgtcgttaagctatcaatatctgctttcacggtccgtaaatcttgctcggctttcattcgtttctcagcgacttcgcttaactgatcattctttaacatggctaatttggtattgttagtctcaacactgtacttcgtatcatcaaagtcttgtaattcttctaactgcactttagctgaggacaacgaatcctgaagcgtatctatctgctgttgaatgtctgctaacgttgcagatttaacttcttttttatcgtttgcgttgttggcatcctttgacttagcgacatactcattaaaaacagacccatacttggcactattggcatacttgctaccattagccaccgcattgtataaggcttgataagcatccagattggtcttagtatttgataccacttgttgcgcggtcttcgttagcgtggctttcttagtactagcagcgctcgatttcgctgccaacatttgattctctgttaaatagatttgacgctgttttaaataactttgcaatagttctcgatacccaaattcatcggtcgttggaaaaacatcactgtcagtattgatgccatctttaaaatgatccaaggctgtcacttggcgttgcaattgccgtttgctgacattatcttcgcgtaatttattgcgattaaaaacgttagtataaactaatagattttggcccttcttcactcgcgcaccttcaactaaataattctttttgatggcactattaacagtcgcttgaatcaccggaaccgttccggtcggttgaacagttccggtaccattaataacaatctcgcgcttagctacgagtgaaaacagaatcgtaccaattaacaatagcgtcactggaataattaataatgttgaaaaattttgaaaccgaatcccgtaaaactcgccactttcgagcaggtcttttctcattattcagttcccccctcagctattgatcaagtcgtaatagtaaccatgttcattcaacaatgccgcatgggtcccctcttcagcgacccgaccatcatgcagaacgatgatatgattcgtccgctttgcaatcgacaaccggtgggcaataaaaataatcgtcttgtcagtcattgccactaaattatcgattaattgtttttcagtaattgcatccagtccactcgtcgactcatcaaatatcaagacttgagcgggtgataataacgctctcgcaatcgttaatcgttgtcgctgaccacctgatagtgtattaccattctcatctagcttagtttggtattgcatggccattttattaatatccgtatcaattaacgccaattggcaagccttcgcaatatctttctcagtaataccgctgcgattacctaatcttaaattttcttcaatggtcgctgaaaagatgtatggttcctgcgggatgtagttaatatgggtccgcaatgtatgcttatcgatgttcttaacgttgaagccgttcaatatgacatcaccactatttggttgataaaaatcaataagcaatttaactaacgtggacttgccagagccactcatccccacaattgcaaccttatcatgttgtcgaatcgtcaaattaacatcatctaagacattttcaccgtaaccataacgatagctgaccccttgtaacttaatatcaccatttaattgactttcattatgaattggccgtgacgcctcaaattcactagcgaccaaatacacttcatttaaccggttgttagcgaccttagcgctttgaagcttagtctgcaaattaataatattctgtagtggattaacaaaataggctaataaagcattatatgtcatgagctccccaactgataactgattatgaatgacgagattggcgcccacccatagaacaacaacttctaagactaactgtataaacagttttaatgcctgttgcaaagtatccgctttaagataggctaaactcttacgtagataatcaacaaattctgaatcaattttctgataacgttccgtctcaccattcagcgccttaacagtttcaatcccatgaagatcctcaataatggctgaactcaaaatagcattgctttccatttccttttgattcaatcgttcaaaggatttattaaaggctaagatgacaaccgcgtagattggcaacgagagtaacgtaatccaaaaaagtgtcatattctggattaccaagattgcccccataataataacgatgctgacatctaaaaacagcgaaacaattgtgctagctaacgcatcaataatcttactggcatccgtaaaccttgaaacaatttcccccgtccgccgagtggcaaaaaaactcattggcaattcaaagacgtgccgaatatagcctaaaataatttcaatcgaaagtcgttgacctaaaaccgccaataaaaaattctgggcataagtaaagatagcctgaaaggtataaaaaacgattagaccaatggccaccactgccaatgtactgtgcatattattgggaatataagtatcaatcaccgcttgtaagaaataagacccacagatactaataatcgtgattaaaactgcagcaagcacaatattaataaccagtcggcgctgctttaataagcttggaataaatccccatagtgagcccttatcttgcttaactggcttatattccgacttcggtgcaaagaaaagggcaactccggaccattcgctttcaaaccgttcctttgacatactgataaccgcaactgttgggtccggatcagcaatcacgacatgtgttttcgaggtttttacaacgacataaaaatgctgtagatccccatttttggtaacatgcgcaaggaatggcaatggtaaatcttgtacctcgaaaagactcatatctgcttgaattgctttggtttcaaaacctaacttttcggccgtttttactaatcctaatgccgtagtcccttctaaactcgttttagcaatatttcttagataggccaatgatgttgtcgaaccataatttttcaaaatcattgctaaagctgcgaccccacagtccatctcgtcaacttgcgcaacatagtttctccaatgcatacttgtactcccctcaccaattattaagtatcggtatctatttaattatgggctaacaaatgttatcgtatgccaactatctattaacgtacataattttatgataaatgtcctcatcaggcttaacggttaaacatcaactagctaacattggtatttgacgttaagagaacgtttttttgcttttataattttttcaacaatctggtaaaaaaataaattaaactaaatttgttccaaataacatcatacaagggggattatttatgctacagtttgagaagttacaatattccaggttgccgcaaaaaaagcttgccaaaatatctggtggttttaatcggggcggttataactttggtaaaagtgttcgacatgttgttgatgcaattggttcagttgcaggcattcgtggtattttgaaaagtattcgttaattttcttgggggagatcaacaattatgaaaaaatttctagttttgcgtgaccgtgaattaaatgctatttcaggtggcgttttccatgcctatagcgcgcgtggcgttcggaataattataaaagtgctgttgggcctgccgattgggtcattagcgctgtccgaggattcatccacggatagttcaagccatcaagtttaagcactataagaaagcactcgatttatgactgggcctgcagtgctcagcctttttagtttatatggggggaattttaactatgccattaataaaagtaataatcacagctatttactacctaatagtgctctttttaatgaatcctttgactgatattatgggaataaaagacggaccctttcaattcatattaactgaatctattatattaatcgcgataatcattctgaataggcgatatgttaagcaacctatccactggctacccgttaatatcatgtcaatattaaagaagaatagtctgcctttgagcctagcaataatatttctacttattttctttcgaaaccacatgtatcaatttttaatctcattattactttcgttgattgtagcgataactgaagaatacgcttttcgtggcatgatattcagaacgcttttagcactaaaccttaaaaaatttgccacattgcaggccaccatcgcttcgatgatgactgcttcgcttatttttgcggctatgcatttggtcaaccttttatcacagcccgtatggtcagtattgtgtcaggttctctatgttattgggttaggtattttacttgcagcaatctatttaaaaaccggaagcttactggctgccattagtgtccattggttgatagatttttctagtttctattctcaaggtattgacccaactcaatcacccattaacgggccaatggaagctcttctaaaggggctctttctaaatattttattcattggcattggtacgtttatcctatcctctaagcattggaagttattgagtatcctaaatattgaagataaaatagacgagtaatcatccattctgaattcctataaattattgtttgcagcactacaatttcaattatctctgaagttttgggttacgctaagagctagtcatatcgctaactaaatttcacgtcttaacgctatgctaatatactttacaatcgagtactgtgcttactttttagtcattttaatactcataagatcacaattagagccctactccaactatcttcagcgcctatattatataatcagatttcatattcataacaaaagagccctgtcaaataacactgacagaagctctaaataatattaaaaaactagttgtctctcaacaacttattcaattcccgcgactttctaaacgaagccttacacctaatttcaccgtcgagcaacaactctttttctttatagtcaaaacttcgcaaatgatttaaatttaccaacgagctcttatcgcatcggaaaaattgcggatacttttcttcgagcgcatttaaatttcctgggaactcagcaaccttattaatagcatggagctgtacgctgcccggtcgcagtttagatgtactcaacaaaatcacatcatctaatgcgagtgaaaagtatcgcgttcctaacttatagttaaaaacatctttgcgctggctattagtcttttttaattcgttctgtactacattgatgtccttaataatcctttgcgtaattaggtcagcagactgatcttttaaaatataatccaacggtgcaatccgccgttccagagtaacaaatgatagctcatcgtgtgttgtaatgaaaactatcttggccaaaggtatcgctgctcgaattcgactagctaattccagtccagcctgtttgtcctcaccaatttccatatccaaaaagaaaaggccatcttgttgttgattcaaatctgctagaattattttttgatcatccgttgcaaccctaagctccattgcaaactcattaatcataattgcattattgacggtcttacaataattatctctttgcgcagcattatcctcgtataaataaattggaaacaatcattcttcctccaaaattgtcaaagttataataactcggtcatttttgctgtcaacatccaggaaaaaattcttttgtttgtctaccaattgttgcacatttgataggccaaagcctcgctgactccctttagtggacgcacctaattcgaacatcttattcacgtcaagtttcttattagttgaatttctcactgaaatttctttcgtttcgtgtagcgagttaaatgcacaagttacctgcttatctggagtagacttggccgcatcaatcgcattatccaataaattaccaacaatccgaacaacatctaccaaattatgcttaattatgaattcactctgatcaagttcgagactcagctcaatccctttagtttgggcatcgaaaaatttctgtacaattaatccccgtaatgtttcattaccaatgtactgaattttagctatcttaccattatctaacgaagtatccacagccttttgtgctattaattctttgaaatattcggcttgttcgactgaattctcatttatcagagaatcctgaagtgacaacattagatttttataatcatgcttaaactttcttagctcaagatattgctgttcaacactctttaaatattcattaagttgcgcattttgtttagcttgataattggctgcctgtttttttgtgtatgaactaataaaaaagaacatctgccataccatcataaccatcataataaagaacgacataattaatggtatctgaataatggcagttatttgtttaaccatacttattatcgtaattccttcgatagctacaaataaaatcaataacataccaaaaatatgcttctgtaactctacatatttaattttatcaatcatggcattaataaacgaagaatattttttcatcaaagatattattaaagcattcattattcccattacaacaacgtagcacaatacgaccatatgtccataatgatagattcgttgctcactagtagttccataagcacacaatattatccatctcgaagtatatacaagaatattagacattataacttgtatattaacaagaaatatcattatacttgatcgcgcgtaatccaaacgatggtaccgaataatttgtcctaccataactgccgctacaactatcaaataagaaatatctgaaacaaaaacgctacccgcacctaataacaatgacataactattacacgcactaatgctcgtttatttaacgcacctattaaatagtaataccacactaaaatagtaaaaaagcacacactaccttgataaaatgcatccgtaaattcaatactcagcatgtcatttcaccatctaatgatggcctccaagtgctttcaataattttgtaaaagcatgggggacttgcaaccccgacatcaagcttatagtctttgtttttccgccaattaaagattgcaacttctgatcatttagttcagtgtacttattaatgtttttcatattaatccctccaaatactaggataccttatattttctactccaattacgttacttcattaacgtacataaaagtgctataaacgtcacgctattcaatacaattgtatactaagtatatttttttacaaatcactttttcaatttccataaatgtaatccctcaacttgtaaaaatgttattattccaattattcccacaactattagatacgccattattgcagaaattaattgagggcgggtaggtgtaacaagctcagaggtttctttcattaagaacaacggtaagtcatctaagaaatgtaacataattgttagcgacaaattgttagtttttaaatataaagctccccaaagcagaccacttgcaaaaacaatcagcatttgaagcataactatcgaccagggactatttacgatattgaccaagtgtgccaacgcaaaacctacgctgctaataacaatggccgtatattgcttgttttttgtgaaaactaagcttaacggaattaataggcctctgtacacactttcttctgccaatgcaataaatagtaccgtcagtatgcttcgtgcatctatcaagcgaaaagacattgagctaagtgtgctaaatcgagtaaataacaaaaataaaatgctcggtattaactggcataattgactcaaaggcttctttaagcttaaaaagcttatctttatatgccagatatttcgactcaaaactattgcaaccaaaaaaataattaaatccactgtcatttgtccatacttttcggaaattatcggactaattagatatggtaaaactatcaacacgataggtacaagaacaaaacaaatcgcaattttagttattatatcgttatttttcaatacaaaatccccactttaagaacatcccccttcagtgaatatcatcaaatcgcattaaatgccaatgcaattccaaacgcaactatcaaaataccaaaagacatcctgatcagacccccaacgcaataaaaggtgaagcacttttgttgccaacctgctttacctgtttaaatgctaaataggcagtataaatttgcaaaattgcaaaacatataataataaattctgtaatcctttcaagcatcttcccactgctttctaaacaacaattatttttaatatagactcgcacataagaaatcgctttcattcgattcaagcaaactacttaatatcactttctctctacaattttaatatactgcttagccgaattattgtacgatatttttacaaacgtaatatttttagatattatcgtacaataattcatcgataccacgaaaatagacgtttaaccaacaattaaagtcaacacgcaaagattccagtctagcttcgccattcaatctcctaggctcaaaattatggtatccaagcggccattaatttccgccaaaatctaggtgttgaattttcttctccagtccgatgtgttgtgcccatctgaccggcaagatgaatagcttttttataaccggtatatgagagatcatgttagaaccgactaagcaattaccatgacgcctgagcccatttaacttcgcgcccagaccaccacaccgcaaaactaacgaaataccaacgacttgatttgcgaacacatttccaaaaaagaactactttaaacgacctcaacaatcaaggaattatcacattagtcatagatttaaataatcgccacgtaagagcttgaaatgaaaaaggccaagtgaagttttctttggtaaaatattgcacttaatttaacaattcgtcatagcaaaaataatcccattaatgttatgggatcgtcagacattcaactttcaagttacgttaaatcggttaaatagtacgataacaaatttaaaataatttttttaaattgtagcgtatattaataagtgcattaaaaatacgtagcgcatagaaccatttttaactgctacagtaaagggagaggtatgactgtgaacaaaatgattaaggatttggatgtagtagatgcatttgcacctatttctaataataagttgaacggggttgttgggggaggcgcttggaaaaatttctggtctagtttaagaaaaggattttatgatggcgaagctggcagagcaatccgtcgttaataaatggacttaaattaaggagcgtatattatgaaaattaaattaactgttttaaatgaatttgaagaattaactgctgacgctgaaaagaatatttctggtggccgtcggagtcgtaaaaatggaattggatacgctattggttatgcgtttggcgcggttgaacgggccgtgcttggtggttcaagggattataataagtgatagaaattgatttcaaaggaaaatattacccgctagtgttagtgctctttgtggctggttatatgggtgcgatctttcttaatatttattttgattggttagcaatgcttacagccggaataattagtttagtcatgctatatggtttttctaacttaaaactgttttttcaaccgttaccctcgccaaagtggcgcatagtagttaagtatgtgcttttattgcttgttctggaagtcactgcgattgtggttatagctatcattaattcgcatgctttattgtcatttcacaatacaacattgacaactagttcaactgggcaagattatcctttaattgaaagagtatggatagccttcacgctactagtatcactagttggtgaggaagtcggaatggcctctatttcacttccgttgattcgcttattatcgcaaacacaactaaaaaaatatgcgtggccgattatcaatgtattggggtgcatcgtatttgcgtgtttgcaccttccacattatcatttcaactggctttatcccttaatcgtcggtattacgcgttatccaataactgcttcatggcgatctgcaaatactttacggagcggcatctatgtccattggatctcagacgccgttttaattattggcacattaatttaaatataaaaggtaaggcacacgttaatgctcaataaaacaataaacataattaagaaatacccagtgagaagcttgctggtagcgcttattgtcgttttcgcaatctatgtgattagtgatccttcaatcattagctcatttaatcaagggcttagtgatggggctgctgggcgatagcggattataaatgattattcaaagctagaaagaaaaatacgagtaagtttgctatagtccccttaaggtaaaagcatcattcatctgtcgatttaatcggggttgatgtaagactgacgtttactttttcatcctatgaaaaaatagcccaaaatctcctaacgaggttttgggctattttggcgaataaatctgccattattttgtttttcaaaaatttaaacataacctattctaggcatgtctacctgtgcaaaatttcatataaggggccttaatatatgctgtttcagtattatttttatgaacagctacaaagccattactatctggaaagtctattttaatagtcccttctttacctactttatattcatagacattactatctaaaagtttcgaaccattagaaaattcaaaagatataatttcttccatatttaccaagctccttctgatatcacatgtccaccaattacaccttttagcaccaactttatcttcttatatcttatagtagtttctccccaccatacccacactatccttaccatctgctacctttttcactttagcataatccaaaattcttcaggcaatacttaattactttccacacttttaatataacgtctacccgatttattggacgatactttttacaaacgtgccatttttagacgttatcgtacaataattcaccgataccacgaaaataaacgtttgactaacacaccaatatccccatcgcactccttgcatcctctcccagactacggcgcgatgaatggcgttctttaagacgaacggtgcaatcatcgtcaccacaatgatgaccaaaataatatccgaatagtaatcgtttgatagtaagtgcgctgaaaacccaatttgtgccgttattagcgccatttcaccacgcgagatcatgccggcaccgactaagtaattactgtggcgactgaacccatttaacttcgcacccagtccacaaccccacaacttagttaacacaccgagcaccgtcatgaccaagatgaacggtagcgattgccagacccccttgaacgtcatatttaaacccacactgacgaagaataatggttcccgaattgtccaatcaaaagcagtattaaagaattcaaaataggctctcattgtcactaattttaaatacgactaaaccagcttcacagccttccatttcacgttttatcaatagcctaacggtcaaaaacatcgacaagtttaatcagctattgttgcacgtaccagatacggcttttgatcggtataattaacagacattagccctggatattgactcgacccacgccgatacatacgggcaacaggaagctgtcagttatgatgctcattacgataccgaaccaatcttagtttttgatagtgtcaccgacttattattagctgttaaacagcacccggtaacgtttatacttctaaagacgtcgatagatttttacgtcccattctcagccattagcgtggtttaagttgcgacatagacattttagtacacggtaatagtggcttttcgacacccgcattatatgatttgtgtgatgaatttaattcgatgaatttcattgtcattttctaatcaatttaaagtgtaaccgccgactggttacactggccgaaagccaagtcaattacgatgaccaaccagatttttcaaagatagaagcccatcaatttgagtttgattaccaagtcacaacttggtctaaatcttatcgatccgtttcccagaatgtttgccctagtaatgaattactgtaccaccatgagcttgtcgtcactaatttaaacacggttgggccggccgatttgttcactacctatcatcaacgaggcgtggtggaaaataacattaaagaagttaaactcgtttttttatggacaaaactaatagccatagtttcctagctaatacgttccgactgttacttagtgcagccgcctataatatggtcctggctttaaaaaaaacggtttacctacggaaaaacggtactatcaactcacaacactccgttggattgcctttcacatccctgcggttgtcagcgccatacccggcgctacatcctaaaactaagtagtaacaacgtttttgatgaggtctattggtcaatattaacgcgaattcgatgcttaacgcaacgagcagtcctatttttaaattttcctgtaaaaccaagggataagtctgcccaaactgacagaatagcgctcaatctgagctgccgaatctacatttgattggttcagcctcaaaaaaataagatctgggtgagtcaaaagactcattcagaccttatttttgaaatgttttaattttatcgattctatgaataaaccggggataaaattacttttgaaaacttttcttatgaaacagtacgtggcaaatgcctaaaatactaacaattgtaaaaacagtctgcacaatccagtctaaactgctcatatcaatattcactgctgcttttacgctaaaaacaaaaacaatcaaccaaccccaaaaattaatgtctttcaaaaaaaatttattaatcacactgaacactcctaaaattgaacatatgggtgctttaaattccaacgtgctttcttgccaagataatatccccaagagctccataacttggttgttaaatcaccgccagagatcttttctaggttagatgtactaattttttcaaatttatccatgtatctccaactccttaatgataaaagcctttattaaaacttttttcaatcgttttgcgatgcttatacgcagaccatagaattttaattccaagcgtatatactgaagttgggactgatccgccctcaatttgagacaagctactcttgcctagagtagaaaatttattcaagttattcataatatatcctttccatgcatcaagaggctgacaactcacacaaattcatttgcatttcatatcatacgtttgaaatgcaattcctcactttccatctcaaacaccccctcgtatattacgtatcactcaatattgttaggcaatactataattacaagccaatttatcaatacactatttttaattcggtttacttttattgcttatcaattcaatactaattgctttctatagctttaatataacacctacccgacctatcgaacgatatttttacaaacgtcatatttttagctattatcgtgcaataattcaccgataccacgaaaatagctgtttagtcgacaactaccacgacaataagtcaacatgctaatacaacaccctcacgcctcgttcaaatctatcagactaaaaaaacgccgtagtccatactacggcgtccaagcggtccttaacttccgcccaatctatgtggttaatgttcttctatgatgctatgtgttgcggtcacctgaccggcacgatgaatggcattctttaagacgaacggggcaatcatcgtcaccacaatgatgaccaaaataatatccgaatagtaatcgtttgatagtaagtgcgctgaaaacccaatttgtgccgttatcaatgccatttcaccacgcgagatcataccggcaccgactaagtaattactatggcgactgaacccatttaacttcgcgcccagtccacaaccccacaacttagttaacacaccgagcaccgtcatgaccacgatgaacggtagcgattgccagacccctttgaacgtcatatttaaacccacactgacgaagaataatggaataaacgtcgtgtagcccactggttcaatactaacgtccaccacgtgttggtaatcagtttgtgcaattgcgactccggcgaagaaagcacctatagcaccactcaagcccactagttctgccaaccatgccaacgctaaacaaataataatcgccataatagttggactggcagccatcaacagatgatcactcaagcgcatcagatacggggcaacccacttaatcacgatgaagacccctatgaagaagccaacctgttccaagagcacgttaccgagattagtctgggcaacgccactctgaccacccatcattgcaatcatgatactcaacagaatcaccccgataatgtcgtcagcgaccgctgcccctagaatcgtggctccttccttagtatccaacactttaaattcctttagtacctccacggaaatcgaaaccgacgtggctgaaaagatgacaccgataaacagtgattcaaaccagctaaactgaaagaagcgactcgcaagccccataataacgactggaaagatcactccaataatagccacgataatggcagggcgtaaatacttacgtaaaagtgctaagttgctttccagtccaccgatgaacatcagtaccacgaccccaatatctgagaacgtttgaactaaagtcgttaaatggacccagttaagtagtgccggccctaatatcaccccgaccataatctcaccaatcacggcaggaatccccgcacggtgagcaaagtgcccagcgagggttgtcgccaaaatcaacaaacaaagtattcccaaaaaatccatgtgctcacccatccatcaaaagtcttaccatctatcatacacctttagtcctggctcatcttgtaagcatgggcgttctggaagcggcgcgcatagtgccagcccaagccgatcagtagaccgataatggcgggaagtgcccaatcaaatcctagtttagctaatggtaagtaccgttgatcccatgcaagaatcgtttgaacccatcctaaccgagtaatcagggctggtgcagcacctagaccatcaatgaacgctggaatcaaagttaacgccgtcgtccatcgataaacgagcggatcacaatgaaatagcggtgaggcaattgctaagataatcagtgtaatcgccaacggatacaggaacatcagcatcggcgtcgaccatgcaataatttgatccaacccaatattagcgatgagaaatgaggccccacaggccaagcggttccaagcgcgataactgattttaggaaatttagcgtgcaaggcttccgcaaatgacgtcgccaaacccactgccgttgtcagacacgtcaaggtcgccataattgctaaaacaatcgcacccggcgtgcccataaaagcattggcaatctgaccaaaggcaatgccaccatccgcagacaacttaaattgcgataacgacgtcgcgccaatccagatcagaccaagataaatgactgcttctaaactaatactcaacaaactagactttgcggccgtcttagcaatcgctccggcatcccgttgaccaaggccccgaatcgtggtgacaactgcaattccgaacaacaaggcggctaacgcatccatcgtattatacccttgcaaaaagccgttcaagaacgcgccgtgttggtaggccgcggtcggtgtcgcattcgtggtccctagcggccggctgaaggcaatcccaaaaattaaggcgagcaaaatcagaaaagctgggtttaacaatttaccgatcgtatcgacgatccgggtgggcctacgagctgcccagtaagtgatactgaagaaaatcaatgagtaagctaataaataccacggtgcctgtgccgaactcacatgactagcaataccaatttgaaacggcgtagtggctgtccgcggcgtcgcgaacaaggggcccaaagtcgcacaagtcagtaccataaaaatcgtcgcgtagcgtttgccaattggccgcgctagctcataaatcccactactgtgcgtcacactgatggcgataattcctaacagtggcaatagtgtccctgtcagcaagaatccccaaccagctgtcaaccaattggcccccgccagctgtcctaagtgaattgggaaaatcaagttgccagccccaaaaaacatcccaaagagcattgatccaataatgatgtaatgtttgattgttaattttcgcgttatttgcatagtcgtctctcctccgttaagcgtcgttctcatcaaccagtttgaacaatcactagtaagagcactcgatacaaaccaccatcactacttgttaagcgcattgtctccatcctctcaactgccatgggactaaaaaagcgtccttacaaaatcatcaattgattttgtaaggacgctaacgcgtggtaccaccttaattcgtcacgaaccgcagctcgtcacctttgcgcgtacggccaattaccaacaccgatgacggttttccccaaacagtaatgttaactgacgatacgttggcccgttaatgggggcacccagctaacactccagctcgtcgcattagcagttctcaggctactttccagccaggttcaccaccgcttcacaccatccagcggctcgcttaagattaccctgactttactctcctgatcatcacgtttagtctcatttatttttaatatttgcaatcataaactcattgcgtagtcttgtcaactgtttcgctaaaaataatcatccgagttaatccgataatgcccactgccgaatcgcagctgcgacccccgttcgcatcattagtagccgtcacgtgatcagcgtgtgccttagcaatatcactgccattgcccatcgcgacagctgttccggcgaaagcaaacattggcagatcattctgttcgtctcccagtgccatcacttcgtccggttgtatttccagagctgccgctaaatcctgaactgcctgccccttgttgacaccagtatgcatcagttccaagaagttagttgccgcacgtaccacgtacaggtcccgaccaaaagtcgtcttaacttgcgcttctacggcatcgagttgcgggccttcacctacaaagacccccttggcaatttgaaaatcagctggtaaatcgtcagggtctcgaatcaacagcccagctttgttttcccacgcctgtacaactgtgacccagttaacatcgcggtcagctgtatagatcgtactgtccgcatcgagcacgttaaagggcacgtgatgttgttttccaaacgcggttaattgccgatagtgcgcattatccactaaatgtttggcgacaatccggccagcaatgctctcgattacagcaccgttatacgtaatcacgtactggtcatcaccagcaaggcctaacgcatctaaataatgttgcgccccagcaagtggccggccggtacacaaaaccaccttaatcccttggtcgcgggcttccttaactgccgcaatcgtacttggtaataattgcccctttgaatccagaagcgtgtcatcaatatcaatcgcaattaatttaattgtcatggattttcgttcctttcaactgcgaatacggttacaattaagtcatgccaccgctcatcgcgaactataattctaatatagcatagcgcgtcagccatcaaggttgatttttgaaaggaagcggtgcgattttacaaaatcttgaagcgaggtttagtgatgaaaatcttacacgagacggtccagacaattccccgcctcccctttaaatattacgaacatgatccattgactgatatcaacgttgccccacactggcaccaagggattgagttaaattatctcgtcagcggtacgaccttaaaattcgtcaccgatggacagacgaatgaatatcggcctggtgacctttggactactaatcgacgcgtggttcacagcgctagtgggcccaccgaagttgactgggtagagttcggcatcatcattgacgacgatttcttacaaactcaaattccggcaagtgcgaactggcaattgacattgaacggcgcggcctcatcgaaaactcacccacaagcctacgccgatgtccgccaacaattagtcacgattcacgacctgttgacgacccccacgaccgatctactgagattacaaatcctcagccacttttaccagttacttgtcactctggggcaaacgtttaccgttcctctgactgcaacaacggtcagccctaacttgacgttaacggatacggtcatgactgccatcaatcaacattacgctgagcccatcgatggtaatacccttgccgagcaatttcacgtttcgttgaccactttgaatcagcaattcaatgcaaacgtccaactatccgttaaccgatacttacgactgatccgattgatgaacgcccgtcgcctcctgttagagaccgaccataagattgaatatattgccatgcaatgcggctttccgaatagtaagacgttcaatcggaattttaaatcttggaagggtatgacgcctactgactatcgtcaagcctatgcccggtatcaccgaattgatactagttgcctctaaaaatgtcccttcgtgatctgaatttcgtggtaagctacggctatcaattaaacgacgggagattttaaccatgattaaattaatggcaactgatatggatggcagctttttgcgtgacgacatgacttacgacgaagctcaatttgcactgctttatcaacaattacaactacggggcgtacggttcgtgattgcaagcggcaatcaatatttccaactcaagtccttcttcaaggactatcctgagatgatctaccttgctgaaaatggggcttatatccgcgatgccgaccacgtttacgcacttaacgcctttcagccagacgcaatccagacgattctgaataagattcaaaccatcccggatttaaagctactggtttgcggtgccaaaagtgcctacaccctaacgaccactaatcctgagcacgtggcgcaaatgcgacattattatcatcacttagccgtcgttgaaagttacgaccagcttgatgatgacattatgaagttcgccatcacatgtccaccagaacgcaccacagcgattgtgacgcaactacgcgagttactgacgggtatcgccgaaccaaccagcagtggtcatggcgacatcgacattatccaacccggcatgaataaggcggctggcttagcgcaactcggacaggttctcggaatcgacctcgcagacatggctgcatttggcgatgggggcaatgacctagaaatgctccgggaggtcggctgcggcgttgccatggcgaatgctcaaccagctgtgacagccgtagccaacgccacgacaggtacaaaccaagaacaaggcgtcttacagtggatcaaaaactggttggaggcgtaagccatgcagccacggttgaccaccaccatcagtattcttagcctctccactgtaacaggcatcactaccgttattacaggaatcattccccagctcaaactgacctttcccaccgtcccgactacgctgattgaatggctcgtcaccatcgccaactgtagcgcattgattactttgttactcaacccccgattaacaagccggtggggattacggccaatcgtgattagtggactcttgatcagcgccatcatgggactgattcccgctatcacgactaactttaccgtaatcatggtcagtcggctcggattaggattaggcgtcggcctcttttcaccacatgccatcagtttgttgacccacagctttaccggtgatttacgggcccgactgttaggttaccagacgggcctctcagccctaggtaacgcgatattgctaggattagcaggcctgctgatcagtctcagttggcatgccgtcttttggctatacgggctactggtgattgttgctgggggcgtggcgtggttcgtaccggaacccactgttccatcaacaacgactaatcacgcacgcactgaaaagacacaactaccacggcaccagtggacgttactaggacttacctttatcacctatctactcatctggggcgttcaattaaagctgccgagttactttagcgcccgtcattttggtaacgctgccactatcaacttaaccttagcagccatgaacatcggtggcttgctggctggtctcacctttggctacctataccgctatttacaccggttcaccttaaccttaggctatgccggagcatctatttcagtcttagtattatggttggcacccaatgcaactgtggctattggcgctgccgtatttttcaactttatttactcgtacaccgggccatatttggtcttcactagcaatactggcctggataccattcaagtcaacgtcctgagtagctacctgacgattgccaccattatcagcgctttctttgcgccactggtctggaacagtctcggccaacttgggccacagacactcaccgccaacgttctcatttggattatgctcattttaggtggcttagccttgattaccggcagccatcatccacgaaaggaagtttaattaatgaccaataataacgatcgtcttcatactggcgaactctacttacctaacgaccctgaacttgaaaaacgccaatttggctatctcgatcagctctatgatttcaaccaaactcggcccagcgaactaaccaagcgccaaattctacttagcaagatgttcgcagaaatcggcccgaagtgttacatcgaaccaccgtttcacagtaactttggtgggcaccatgtccactttggcaagggggtttacgccaattttaacctaacactggtagatgatacccatatttacgttggcgactatacgatgttcggccccaacgtgacaattgcaaccgcgggccatccgattttgccatcattgcgcgaacaagcttatcagtacaatatgccagttcatatcggccgtaactgttggttcggcgcaggtgccatcgtactacccggtattacgattggcgacaatgtcgtcgttggcgctggtagcatcgtgaccaaagacttacccgataacgtcgtcgccgtggggaatcccgcccatatcttgcgacacattaatgatcacgaccgtcagtactactttaaagaccgccagattgatcctagcttgttaaattagtggtttcaaaaaatcagtccatcgcattctctgcctttatcacggcagaatacgacggactgatttttaatatgcgtcaaaataattaattctcattcatttgataactgctatcctcaacaacatagccttaagtttagaacagccattacaccacctaactatttatattatattcgagtaacccatcattactgattgttttatgatacgaacgtctgctcaacctgactacccgtaattaagatcactatctgagctgtagctcaaataaagtattattttacaatataaacttcaaaaatccttggcttaccaccaaccataaattgaacgacatccttttcccaaaagggtaaaatatcatcctcaaagctgtccattattaacctttttaatttaggatttttattcatgaaaaaatcatatttatttattattactgcaattttttgattgggtatccagctcaagtctgtcatccaatctgaataggcagcaaagcctgcataatctggcattttaaattttttacccataaaattcagatattgacgaaacgtgcgaacttttttgcctggtactgtaacaacaaaataatttaaatcattcaatcgttctttcaacgacacaagctcaactttatcgacaaatgaaattttattttccattattacctcacttaactttccgaatctaaaattaaagtgtaatacataaaagactaccccccccaaaaaccatcgaggcctatttcccctacccatactcaccttggaaacacggattaggcgtaaatccaaaccggtaaattcgcgattttattttcaaaagataatttatgcgattcttaattattactgaaatccaatccattcaagatgttttgaaccaatacgcatggtagacacttacttatcaggtatcatagatggttattttattaactgatccactatttaacgtacgtgttacacttgttttgagaacccggagtagaaaaattagtggctaatttgattataaaaatcgcctttaatttctaacattcaatgcgatatcttcatttttattttcagatagcagaataaggcttctaccaaattgctcaatcaatcctaactcactataaatataaaatttacatctatgctttctatcaggattatcgtcaatctccatatcaatctctatttttacacgcccagaattatcggccggtaaaaagcttaaagaaaatgctggtgtaaaatttccttctttttcaccaaattccacataaatttcttctttagcgtcgaaagaatatgcaataattttctcgccaatttcttttaaatctgtatcttgtacatagcacagttgatggattgttacaaattttgatttcgcattaatacttagttctaataaattattatcttcccaattttttgatatttctaaattactcatattttctcctctcgtattacttattctcacattggatgaaacgatacgacgaaaccgttgtccccatatgcgactcgatatacttttccattaatgttatagtccgcctatgctgtttacatacccctttaaaaataactttcagcaatatcaatgtcatgtgccatttctaatcctggaaactttttatccaattctcttaaacaatcaataaaattttgacttttcaagttggcagaaatatcctcaaaaacttcactgatccaatataagttgtccgcatcacaatcttctaaatactttattgtagtatcctcattaagagacaaaaattcagtcactttgttccaatatttttccataccacaatcatcattcacatttaattttttcctttcaacctgtccaaacttgcggacttatcccaagtgacctgcgcaacggtctattttgcacatctcttactcaccaagagaatatggcactaacgagaatcggaatcagttaatttgacattttagataataactctgttataacaaactatagatcagatgctttttccttgaatttattatatattttcataaattcttctttttgagttctttatagattcttacgtatttagcatttcatctaagtagttccagtattccccgggtacgtctgtttttggaacagggttttcttctgagtctcttctagttccactaaaatctccatccgttaaatgatcagcaacattattatttacacttttcttttgaacaggcgtcaactcttcttcaatactttttggagttttatctccactcattttcttgacctcatataaacatcattaatacccaactagattcgttagaaatgatgcccttattttcataccagtaatcgtctaaaaagtccagaacgcgtaatttcatcaacattctggagcttcaaccgacttattttgtttgcttattgaatcgttgtcgtctccaaacaaacaacaggacatagataacggtaatcaccaagttaccaactaaactagttatcagttctcaaatgccgtcaccaagtacccgcacaaagactaaccggacgataaaataccaacatgtgttgttgcctccctcataactcaacttttctataaaataaccgatactcggcaattagcccttgtcgaatatcggttattttaatctgactaattcatattacttattggcccggtgcttccccaaacaaataagccatagtaaatcaaactgaataacaagctaccgactaatgacgatactagcccatgtgtcgcagtttgtgtcatcacagctaagattgctcgaacggcaaagtaagctactggaataacagtgccaacaaaattagattgattcctttttcccagtaaataactccagtatcctaatcccagcgtaattcctataattactactccaataattataatcgttgccatttttcaacctccaattaatttttggctattttcgcatttcaggttaattttttcccggatttaaaatctaagtgcaacacctaaaaaactggaccaaaaaggccacgaagacctattcttaaatcaccacgaactaagaaagagatgtcttcatgacccataaccagaatatcattacttgtcactaccaacaacttcaaccttacgaacgtggcctgattatggcccgggcaatctgacggctggtcttgccggcggattgcccgcgaacttcatcgcaaccctagtaccatcagtcgtgaactgaaacgtgggacaatccggcaaatcggcgctaaccataagccttttatggcctactttgctgataccgcccaagtcgtttatgataaccatcgaacagcttgccacgcagtcagttggttactaaaggctcctgaattcttccgtcagttgttgattgagttccgccgtaaaccgcgtgtccacagtatcgactcttttgtccactggtttaagatgcaccggtccaaattaccgtgtcctttgacacccacggtttaccgttacattgacgaaggccggttagaactgactaatagtgagctcccgatgaagttacgccgacggataaagtcggcccataagacccaccagcgcatgaataagcgctctttaggccagtccattgaagaccggccaaccgctgtgaatggtcgtatggaaggcggccattgggaaggcgatttaatcaagggtaagcgagttgacagtgaaccatccatcatgactttgactgaacgggccagtcgctacgaaattatcgtcaagattgaagactaccacgctgaaacctgtcgtcaagcgcttcaagacatcattgacgactacggccccgagcactttaaacccgtgacctttgacaacggctcggagtttgcgaacctatcccaagtgactggtacaacgttctatttcgcccacccatactcaccctggaaacggggatccaatgaaaaccaaaaccagttgattcgcgagttcgttctcaaaggacggtcgatgcggtccttgaccatcactgagattcaagatgggttaaatcaacatccacgacggatactcggctatcaatcagcttcaggttttatttatcttgaaaatttatcgaaaaaatttttccgaaaatcacagacaactttacactttcattactataaaagtacagttggtcttcattcttttttaattcagaaatattgtctaactcaatggacagtatatcctcatctttatagctcaaaaaaacattacatttcatttcatacgtatatatgaacaacgtcaattcgaaatcacttatttctcttctgtataaaacttctccatcatctatttcgcctgttaagctttcagattctgaccagaataattctaacaaatccaaatcattatattttgtaaacatttttgtttccctcctatctgggaatgacagtaacaacgccacctttatcattaatgattacttttacatctttagtttcacaagcccacgttccttattatctcgaataagctcattttctattataaaaatttaaattcaagctccgtaaagtcactcatctgcttcatataccatatacggcaataaagtacgtttatcctaccaagcataattcaaataaatttattgaagtcaatcaaatctactctatcacaccggaagtgaacaaaatcgcctctcttaaagccttcataattttcttcaccactatcaatcacaaactcaccaacctttaatttccaattttcattgatttgtccatacagatcatacgaatattgaatatctgataatgctttcactgcaaatacttttcccttctgcatctcaacatcgccttccaataatggaaataaagtcatatagggatattggtacttgtctcctattttattattgaattcatcggcaaaaacccatatttgaatatttccatcacttaataaaacaaaaggatctcgatattcaggatcatctggtggatcgacttgcaatactcttatcatagttcaactccttcttaaacatttaagactactccaaaatgactccttttttgcgaagaactcttgttgtcttaacatgtaaagttgtaatcctggctgtcttaatatcaattcctacaaattcataattataaccatctctcttcttttttgccttagttgcctttttgataaatgcgtgtaattttggtacatattttccatgtttcactacacttatggcttcttttttatactcattttttgtgagtagctttttacctgtaattttcctaatggatgcaacatgtttcaaaaagtgttgccgcaatttctcattgcttgtaaattttgaaatttttccattcttcgccatgcctttaactttagttgaaggcatgtttgatctagtttgacttctgctttttttacgcttgcccggcttctttttagtaccgccctttttccgtgcatacgaagctttcctagccttgcctgcagcttttttcttgttatatcgcttctgctgcttcttggtcgttttatgcttcgtgccatgggaagtctttttgggctttgcctgttgatgcttagcttttttggcagtcttgacctttttagctttacgagccttctcagctgcctttttcgcagtctttttggcgggctttcgtttagctagtttctcggccgctcgctttgtcgccagtttagttgctcgggcggcccgtttgatccggccaccattcttcgcaactttctcggccttcttagcagttgccagaaccttcgcggcctttgctaacttagcgactttcgagacaggcacaaagttcaaggctgtccaagccgctcctactaaccgcgagcgcttcttaccggtagcggcatcttttcccgtaatcatggtataaatatcattatacccaactagatccgtcaaaagcgaaatgatgcctttactgataccggtcttacgactaagcgtggcaattacagcactacctttggatgcatgctttttcgaagattttttcttgttagacttgccgtgcttcttagatgatttcttcttactggatttaccatgcttcttggaagatttcttcttattggacttgccgtgtttcttggaagatttcttcttgtgcgacttgccatgtttcttggaagactttttcttattggacttaccatgcttcttagaagacttcttcttgtgcgacttgccgtgtttcttggaagacttcttcttattggacttgccgtgcttcttggaagacttcttcttattggacttgccatgcttcttagaagacttcttcttgtgcgacttgccatgcttcttggccgctttcttcttgtgcggcttcttatgtttcttggccgctttcttcttgtgcgacttcttatgtttcttggccgctttcttcttgtgcgacttcttatgtttcttggccgctttcttcttgtgtgactttttgtgcttcttgaccgctttctttttatgggccttcttatgtttcttagcggccttcttcttatgcgcctttttatgacgctttggcgtttttttcttatgccttaccgcaactttccgccgatgcggtgctttacggtggacgactctgcgcttagctttgcgatgtgcacgatgagacttcttggcgtgaccactagcgctatgtcgcaccttatgcttccgagtgtgggtcacaccacggcgatgtgcggagactgtgtcgaccgagctggaaaaagccgtgaaaactagaacaaacaccattaggccaatgaggatttttttaagaacctggcgtaattttatcatattagtcacgccctcgtttcttaataaccatcgtaatcgctacagtgagtagcaacaaacccactcctagccagaccaaccaggtcgcgaccgcggagttcgttttaggcaaaatttggttcaagattggatgttgcttcttgaacgccgatcgttgcttatcacgacttgccgctgcagcacttgctgaggttacacttggaactgacgcacttgccgtcgtagcccgcgactgccgtggcgctgtagaactggtagcggctgcgacagttgctcggttagccttggtcgttggcgtggatgaagcctgcttcgtattagctttagttggtactgacgattgactagtgaccgtgctagagcttactgcttgactgctaccattaacactgttcgactgagtttggctggaacgagctgcggcctgtttatccgcgtcagccgaatcactggtcgtacttgagcctgatgaactttctggatgactactttcacccgagctagttgaatgacttgattggctcgcatcactggtacttgccgaactagtcgaatggtcgactgcacttgatgctgtacggctactatcactactattagtgttcgattcactagcagcactctcagagctggtcgtcgcactacttgctggtgccgcagtcacatcattgttttcagctgcccacgcataacctgaacccaatgtataggccattcctttatcaccatcataagtatctaggtaaaaaccgtcaccatcggccccaccatcaacttctacagttgtatctggcgacacatagagattttgttccccttgatcagccttcagcgttccttcatataatagtttgccattttgagtcagacgcgcccgggtattcgtggcttgcgcaaggggcgtcgccgcgctgcttggattgttgttcggcgaaaccccttcatcattactgaataccggatcattgactggcacgccttcctcaaaagaagcgtcctcacccaagacaaccggcgtggaattgggttctgcaatcaatgcttgtaccgctgcactcgtatcactattgagactgctcgaagtttgggcgctgcccagtgcactacttgtgttttgatcctcagtaaatggtgacttgaaacccagcccactgtcagtagttgttccagtggtcgtatcaccggtattggttgtttcaccgtcagttttaccgtcagtagtttgactagtgcttgatgccacactactatccgtctttgaatcagcacttgcactagtacccgactggcttgtagcctcagtgtcgccttgactattcgctgaacttgcatcgacactactggacgcgttcgttgcgttggtcgaactaccagctgttgattcattagtctcagtttggtcagtcgctgtcgtacttgtcgactgattactaccagactgactagtatcagtcgttgtcttggactcagtcgttgctgcttgactcggattgatttctttttgtgcggtaactttcaacccattcaacaatcctaagtcgtattgttcgccagtcaccattgatttcaacccgtcaaccgtgttggtctgctggctcttagtgccattcgcgttagtcaccgtggtcactgtcttgagctgaccacttttatcaaaagtcgtgaccgtttgctctgcgcctaacactctagtcgcagtcacttggccttgatcatcaaccttaaaagtgacagtctcattcttagataattcaaacgtatacttcgaattataatcaaagactaagctgttatcttgggtaccgttcgtatcactagccgcaatcgcaacttgagccgcatcctgattatatttgaccgtaaaaccactatcgttggcataaatctgcgagacagaacggacattatgcttcgtatcttgtcgtactaaaacactactttgattaccaacgtcaacccactgcccagtcgttggttggtaataataattgaccgttgttggcttttccgttaccgttccctgggcattcgtcggtaagcgatcagtatcaactgtgtacaaatcttcgaaatcagttgcctcggtcgtgtaagtatcaccatatagaccagtgacatccaattcgtccagcttctgcccatccgttaacaagtaattgacatgaatgttgtatggcaacggatcataatacatcacggcttctttggtagtcttactagcagtgccacgggtatgttcatccaatgtggcattacgcttatatccagttatcgttttgacctgcttagtaacatcataagctttcccgtaaccaactttgactgtttcatcaggagcaactttatcagtagaatcggtcatgtaatgatgtaccgtgatggtcgcttgattgtcaatggtattggtgaccgtattcgacgtcttagtctgcttatctattgccgtttgaccagttgccgttactttggtctggtcatcaacatcatcactgaactggacttgagccttaaagtgataggtctcacctttaaacggtagcgatttaatgcctgcgtccgtcagatgccatttcacttgatgtgttttttcatcatagctgacttggtaggcagtactaggtaatgcttggccagcatcattaacgacttcgcctttagtgtacttagcgttagccggaatcgtaatattttctgaccaatctttatacttggtcattaaatcctgatccaaaacattgactttttgttgtaagtcatacgttaacgtccgattttgcttgtcagtggcactttgtgtggcactcaaagtgggcgtcgcaatggcgggcgtccccagcgtgatcgtactaacgttgtagactggttgtaaccatgaattaccactattaacacgggtcgtcccgtagataaattccagcttcgtcccactgaccccaaaagttgcagccgttgacgaggtatatggccagctcgcatcacgcgctgtttgcccagccatgacgagttgtcccccaccgaggggattcgcaatttgcttaacaatcgagttttcaacagtataaatcttaccagcccctaagtaagccgtatattcaaagccggttgacgtccccgctaccggaccatccagactagatagcgtaatgaacgcgttttgaatattgaccgcggcatgcgtatcagcgtaataaaattcatagctcacattgaattgggccacatttgacatggtcgtgtccgaagaaaagcccgggccaatttgaaacgccccgtcagtctgcttcattcccgacggtgccttgtggctgtcgtcgtgaactttaatatgtgagattgttactttagcagtgacttcctgaccatggaaagttcccactgtcccataggttgaagtaatcgtatcactgtctttcaccttatgtatgagcacacgttgcgcaccgttcttaggtgttagactgccacgatctccagcattattcgtgattccttgtaaggccgtgtcattttgcttgatgactagctgattgaccagtgggagcgtgcccccgttgcctggtaagaccgtgaccgatgatgaagcatcaaccaccatgatattttgtgacacaccccagaaagagatgacgaccagtaatggcaacaaccaaactggcagaccattacgatgatgtttccccgtgttttccgtatacatgtttaaccccttttatctaactatcacttatatagtaaagcgacccaactaactaactactcatagcaggttaacatgtattttgttaaaaaacaataaatatttttatattaatatcaatatacattgacattttcaattgtataaattctttacgtatcatgctgatttttctaccctaaaccatggttaaagcttgccatactaagcacaagagcaaccagcttagatcagtttgaaaagtacaattttgtataaacttgcttatttagctatggctttcttccggtttagaataaggtccgcatttactgataatcagtaattcaactaaattggtacgttttaatcataattaatgcaaaatagcacctagtctatcaaatattaagccttttttatgctaatcgaagactacctaactgaaagacattttatatgttgccaaaccataaaattttaattagcagatgtcttttactcagttaatgaaagcatgcatttcaaccattactcacaaataaaaccgtgaggactgttgtcaattccaacagtcctcacggtttatatcaaatcagtcataaaattatggcaatacattaaacaacagtgcgcctaacgcgccaccaaccaatggtccagcgattggcacccaactgtaggcccaatcagaagttcctttattggcgatgggcaataccgcgtgcgcaatgcggggccctaaatcccgggccgggttaattgcatacccggtcgttccacccagagacagcccgatagcgataatcagaattccgacaacaatcgggttcaatcccgccgtaaattggcctttcgtgaaggctaacaagccaaagactaggacgaacgttccaatcacttcactgataaagttccagaaataccgccggataccaggaccggttgcaaaaatgccgagaatcgcgccagcatccttagttgcttgccagtgtgggtagtagtgcaaccaaaccacgaggccaccaatcaccccaccagcaatctgagccgcactatatggaatcacgtaggcccatgggaacttaccggccactgccattcctagtgagaccgccggattaagatgtgcggggctcataaagctggacgcatagacgcccatcgtgactgcaaatccccaacctaaggtaatcgcgacccagcccgcattttgcgctttggatttattgagtgttaccccagctacaaccccatcacctaacagaatcaagataaaggtcccgagaaattcccccaacaattgtagtgctaatggatctttcatcatgaccaccccattccttagccctgcttcagtgctgttaagtccgattcagcaatcgtctgattcaataattcggtttgtgctttgaccgttgcagcatcccaaccaagataatcggccattgtcgctatgacgccatcctttaagccatccagcgtatctcgcatgaataacaagtggttagtgcgccgcagcaagtagtcgactggcgtcagggtcatttcttcatccaaggcataacgtaagctaatcgtttcagctaagctcagaccatgcgtcggttcaactttaccaatcaaactaaagacccgcgcagcattggaaccgtacatatttgcaatccgcaacgcttcatcattcgtcaaaccattatccgtcccttgtttagcataaaatgcaatcgttgcatccacgttgtgcggatcaatatcgccaccagaaacggggaggttcttcgaattgatttcattaaagtgggcatcatacttatctgctaaaatcttggcaatcagcgccatggcacccgcagccattttacggtaatcagtaatcttcccaccagcaagggtcaacagcccgtctggactactagtcaacgaactaccgcgtgaaaccgctgacggactgagtttgtcctctgccaaggaagtttccaagtcattcaggacactttcgacatcttcacgactggcttcctgactttcaaactgatcaacaaccttgataacttccttgaagctcttatcactgatttttcctgaattaccaccgttataatcagaactaccgttagcggcgatcagtggccgcaatccggcccaactagcctcaatatcatctaaggtgattttagcagttggaaagcgacggttgacgatttccaacaagtaatcaacatcttcttgcgtaacggtcgggtgtttcagatcaccatgataatccgtatcagtcgttccgaaatacgtcttgttttcacgtggcaccacgaagatcatccggccatcttgatcaccagaatcaaaataggttggttgtggcactgggagtttctcagcgtcaacgactaaatgtacacccttggttggccgcatctgggattgatacttttcagtatggtccatcttacgaatcgtgtctgaccatggaccggtcgtattgatgacgattcgggcatgaatctcgaacgatgcaccagtcaataagtcttcagcggtgataccattgatccggccatcatcatcatgtaagaggccggtcgccttcacatgacttgccataatcccaccattttcgtgagccttcttaatgttttcaatcactaggcgcgcatcattattccgaaaatcaaggtaaacaccgccaccaactaaatgtttagggttcagctgtggttcccgttgtaagacttcctcgcgcgaaagggtataattggtgaatttaggatctttaacttcggcgagcttatcatacagatccatcgccactttgacagaaaagaggtcgaaggtcgctcccgtctcatcataaatcggcaataacattgggtcgggcttaggaatgtgtggcgcaatcccctggacgaccgcccgttctttaacggtatcggcgactacccccacgtcaaacgtctttaagtaacgaatacccccatggaccagtttcgtcgaccgtgatgaagtcccttctgcaaagtcttgcatatcgatcaacccggtcttcatgttcattgcagttgattgaatggcgacaccggcaccggtaatcccaccaccgataacgagtaaatctaacgtttcattttgtaagcgttcaatattttgttgacgcgtcgttgctgaaaatgccatgttgttgtcctcctctattttcctgcgtggtatggggtgtgcttaaagacttgggtcgctttgaccgctgcctgccatccctcgtataagttcgtccgttcagctggccccatctcagggtcaaaactcgtgccgggcttatacgacgcttttaattcttccaaatcctgccaataaccaacgctaagcccggccaagaaggcggcaccaagcgctgtcgtttccagattagcagcccgcataatttgcgtatccaagatatccgcctgaaattgcatcaaccagtcattacgagcagcgccaccgtcaacttttaatactggaatctcaataccggaatctttcttcattgtttcaaccacgtcccgcgtttggtaagccaatgcttgcaaggttgctttaataaaatcttcacgagtcgtgccacgcgtcaagccaaagactgagccacgtgcttcagagtcccaatatggtgcccctaaaccagtaaaggccggaaccacatagacttcattttcattatgcgattcgcgcgccgcccgttcagaatcgggagcgctttcaactaggcgaatcccatcacgcaaccactgaatcgctgaaccggcaacgaaaattgacccttccaaggcgtagtacactttaccgttgatgccgtaaccgatcgtggtcaatagattattatcggataattggggtttttcaccggtgttcatcacgataaaagccccagtcccgtaagtattcttcacggttcccggttcaaacgccagttgaccaaacaaggccgcttgttgatcaccagccatcccactaattggaacttccgacccaaagaaatgatagtccttggtcttgccataaacttcagaattagtgcgaacttctggcaacatcgccgctggaatatttaataattgcaaaatctggtcgtcccacttcaaatcatgaatattgaagagcatcgtccgactggcattggaataatccgtcacgtgggtggccccaccggtaagtttccataggagccacgtatcgatcgttccaaagagtaattcacccttttcggctcgttcttgggcccccttcacgtggtctaagatccagcgaattttagttgccgagaagtaagcgtctgtgacgagtcccgtatgttgatgaatcaaatcaccatagccatctttaaccagcttctcagcaatcggcgcggtttgccgtgattgccacacgattgcgttatagattggcaagccagtttgcttgtcccaaacgatggttgtttcccgttgattcgtaattccaataccactaatttgagcgggtttgattcccgattcaatgaaggcattcgcaatagtagacaagacagcattccagatttcattggcattatgttcgacccagcccggctgcgggaaatactgtggaaattcccgttgtgagtcggccactttatggcccgcatggtcaaagataatggcgcgggtactggttgtcccttcgtcaattgccataatgtacttgtcggtcatggtgtgtcactccttagtcataacagttttatgaaaacgctatcataattgatgattgaatcataccatgttgcgaccgttttgtgaatagatttgcataaattaaattttgcacaattgaatttactttaaaactagtttgtactatgtcacagttcgatactgccatagcaagcatcgtagcatttaagcaatcgcttctagttctataaaataattaatttactaacattagtgccaccgcgacgagctacaattttgacattttttcacagtacttacacgccaagatagtcgcacaacgaaaatgacgaccgtctgtttgcgacatcatttggcctccgtattccactccaaacgccggtcaaacaaaaaaagagtggccggtcattcctggtcactccgttagtgctgacatattcagttaagctgaatagctggactttgatttaattcaaccacacattaatacaaatattgtaagtcactagccggcgttgggtaagccaataccaaccgttgtaaatctggtaaagtcacgtgtttttcaattaacaacgtgaagtagttaatcatctcgtcggcaacatcacttagaagggtagcacccacaacctgcccactcgctttagcaaccactactttagcttgggcttgttgtgcgccaaagcggtaataagtgaaccacttcgtcatatcaagtgtattgacacgatactcatctggatgctcagtcgccacggccgcgctgatcccgacttgcgctaacttgggcgctgcaaaaacctgcgttggcacaacgggatactttatggctgcgccaggatgcgtcaactcaccgaccagataacgcgcttcaaaacctgcaactggcgttaacttcggtaccggtgtatcgctgacatccccaatggcataaatgtgcgggttggccgtctgcaaatgatcgttgacttgaatcccatgccgatcaaaggtaacgcccacgttggctagacctaactggtccgcgttcggaatccgtcccgctgagctgatgaccagatccgttgtcagctcgaaattatcagctgtcaattgtagaccggtcgccgttttagtaattgcttggacatccgtattcaagtcaaacgtgattccatcagccgtcattgcggccatcaaatccttaaccaaatctgcatcaaaagcttttaacgggcggtcattatgatgaatcacgtgcacatcagcgccagcggcattcgcaatcgtcgccaattcaaagcctacgtagccaccacctacaaatgtcacgcgtttaggcatctggtccaaatctaagaagtcagtgctcgtcttaaagtattcgtgcccggtaatcggtagaatcgctggacgctgaccagtagcaatcacgtaatcagtcgcactgactactcgatccccgaccgctaactgattgtcggattgaaagtgtgcttggccatgtaacgtcgcaatatcttgccccgttagtccgttcaacgtcccatcgttgatgccatccgtatagcctcgtttatgcgccatcagtgctggccaatcaattttgggcgcgccaatcaggccctgcccttgtaaatgttgcgccgcttgtcgcgcttcgacggcgcttaacaggattttcttagggtcacaaccgcggttaggacaagtgccgccccacagatccgcttcaacgatcaacactgtcttgccctgggcctttaatccgctagccatggcattgccggctggtccgccaccaatcacaacaacatcgtactgttccgccattcgaaattcctccttaaattcattagcgaccatcaattatcacaacctagtgtaactgattcatccttaattgacgattaagatacttcttcatgttgactcaagtaagccacgattcgttggcgatccaaatagccaacaacccgattttcttccgtgaccgccacataatcgtgatctgtcaatgccgtaaaggcggtgcgtaacgtggcttgaacgtctaacgattgaatccgaccactcgcaacactgggttcttctgtgagataaccctgaataagccctacacgcccaacgtagacatcatagacatttttagctcggctcgcaccaaagaagttccgcacaaagtcgttcactggatgctgagccagagcagccggcgtatcgacttgtattaactgaccgtgttgcatgacaccgatccggtcacccaacttcaacgcctcattcatatcatgcgtcacgaagacgatcgtgttgtgatagcgggcgtgtagccgtaagaccaagtcttgcaattgttgccgcgagatggggtctaacgcactaaatggttcatccatcaaaacaatatctggttgcgccgcaatcgcccgtaagataccgatgcgttgctgctcaccaccggataattctgacggcatccggtcacggtattcctttggatcgaggccaacttccgccaatagctcatcaatcgtttgattaatttccttcttagctgtccctttcatttccggaatcacggcgatattttgcgccaccgtcatcgttgggaacaaggcaatttgctgtaagacataccccatttgccaccgtagacttcggactggtatcgtggttgtatcagtaccattaactagaattttaccagccgtcagtggctctaagcagttgatcattttaagtgacgtcgttttgccactcccagaagtccctaccaaaacaaatagctcaccctggtcaatcgttaaattaaggtcgggaatcacggtctgcccattaaagtctttctggacgtgttgaaattcaattgccgttgtcatttaacgtccctccttcaataaaccgtgcttcacaagatagcgatgtgcaaccgtcgaagcggactgcttcttaacattgacttcatagttcatttcttgcatatcagtttctgaaatctttcctgctaacttattcaacgctttaacgaccttaggatgtttgttggcaaagctcgtcttcatcaacggtgccccttgatacgttgggaagaagtgcttgttatccttcaataaggccaagtgatactgccgtaattcactatccgtcgcataggcatctaccaagttgattttccccttactgatggcttcataacgtagcgccggctccatcgacttggcagtcacgtctaacccataagtcttcttgattccttttaagccatcattacgatcaataaactctagggtcattccgggtttcagaatcgattcaacttgcgttaagtcgctgattgtcttcaaatgatgttcttgttgaaatttcttagtcactgccaatgcgtacgtattgttatactgcatcggcttcaagtaagtcatttgttcctgcttagcgaggcgctgtttggcgagctgataggtctggttagctgtttgaccagctgggttatttcccttaactaaggtctccagcaccgagccagtaaattcaggataaatatcaacctgattattctttaacgcgctgaataagaacgtggtcttgccaaagttaggcttgagcgtcacatgaacgtgttcatcttcagcttcaatcagctgcttatacatattaatcaagatttctggttcggaaccaagtttacctgcaatcgtaattgtttcaactcgattggcatagacactataagccccgccaccaccaagtaaagctaaaataccgacaaagacgattaaggcgtggcgtggtttagccgtttgaaaccaccgaacgagcgcactcagcagaattgctaacaatgctgatgagatggccccaatcaataataacgaagtatcattacggtcaataccgagcatgataaaggtcccgagacccccagcaccaatcaaagcggccaaagtagccgtcccaatgattaaaacgagcgcggtccgaatcccagcaatgatctgtggtagggcaatgggtagttcaactttaaacaacttacgcattcgtgacatcccaaaggcatcggcggcctcttcaattgaggcatcgatttctgagatacccaagtaagtattttgaaaaatcggcagtaaagcatagatcaccagcgcaattactgctggcaccgttccaatcccaactaacggaatcaataaccctaacagtgccaaagacggaatcgtctgtaggacactcgtgagctgtaacaatccctcggcccaccgtggtcgtcgaacgacccaaatagccaacggaatcgcaattaccattgcgatgactaatgatgctaatgaaatccccaagtgttgccatagcgcagtcagcaaatccccgcgtcgatctataaacgtctgtattaatgtctgcatgctaacctccagtgctcacctttattgcttaataacttcttaattatccatgtatttaatcgtagcataatccgccaaaaatcatagtaatacgcactgacaattcactaaattttgtaactattgtagtttcatattaaaattattcattaatttaaaatgaagctggctagtttttacgaaactattagatgaaccactcaatggattatcattacaactaaggaggccccaacaatggctacgattcatctttaccttgcaagtaccaaccaccaatcgaccaacatcaccgcaacgacccccgctgcctgggtcgtcattctgcgatatgctgaccatcaaaaggcgctaaacgacggtggctacggacataccgaaacttcactggccttgagtgctctgaccaccgcactcaccacgttgaaacgtcatgatttacccgttcatattcacaccacaactgaacaagtggcggcggttattagcgaacaacgttatttaagctggcggcaaaacaactgggacgttcccgaagccgaccaaccagacctaccccaatggcaaacgttgattcccattatcgaaaaatttcccaacctcaccatcacctaccaccccgtggacgatcccgcgatgaccaccgcaacgactacgctaacggcggtgatgacgaagctataaaatcgaactcatttcctgtcagtcattttggacataaataagccgatcgtatacttgacggtcggcttatttagttgaattaatttcttcataactactgttacaatctcgcaacaaattctacatatagcttatttccaattgaattcatccacaatgattgaccaacaactacaggtcccgcacatcttcagtattagatgtgaaataatattcattgataactcgatacttccctctagttctttcagcgatttcttcataaatcgcattaaagtcacgttcgaatgcattctcatcttcatgcgttttaaatccattatatctaaattcataaccattattggtaaacagctcgctatactgacgatttaaaacgtttaccttcgccactagtcctgaatcaggatatagctcatccgggagtccatttttaatcaattcattatcctcgttatatacccaaataaaggaagaaccccattccataaatagtcttattttacgttttggcatagtagtgtctattgactcagttgctgcggccatcgatacaacgcctgttttccttaaatacatcttaacttgtaatttattggcaggtaaaccagttatcgtaatattggttaacttattatttacaaagacagcaccacaatcagggcatgttttcaataatcgcttatgggcattagtcgtactcaattgaagtcgagccagattacatttaaaacatagttcgtccaatgtataccgactcataatatctatcaattgcattacttgccgacacattgccgcattaccaatatttttcgccaccatatctttattattagcaacaatctcagataagttcttgtccgtatgaccaagaatataatctttcgcagtagattgttgaactgttttcaacgtaacttgaccggtatattttgtaaatcttctacgataaagcttagttatatcgactaaagcgtcatacgtagggcctaaattttctatatcaaaattctgataaaccttcaacagatcagcttttaatcctggatacgtccgcacatgagtctttgcttttttatccactacaggtttaggtttattaacgatagcactgtttaattcagcctcactcggtatagcttgcgacgatgctaccgtcgttgctgttggaaataccttgtctactttccccgtaattttgtttaagaccgcgtacttcccccctagtcgccgcttcaaatccttgtgaataaccatgaatgcacgtaaaaactgctgttcatctgccgcagttgcaaaaccattgtagctaaaatcatgctgattattagtaaacaaactatcgtattgcttttgcaacaccaatagttttttattaagcgttgcgtcctttcgcaatacttgcggcaaatcattactaattaggttacccttctcatcatacaaccaaatcggataacaaccatattccaacataattcgaattttcttcacccgtggatatttatccaacaacggcgccggataagcactaataatgtactggtctcgcgacaacgtcactgctaaaaggtgctttcgataccgatagtgaatagtcaatagtacacgatgatatggttgccacttgtcaaagtgccccccagatcgatgatagctattaacagctttcgcaaccagtttaggaatagcagtttgtgaaactccttgggctgcaaatgcttcaccatgattttgaataatatgttgaaaacccatgtgttggttgccactatcaatccagtcaaattgagtatcatcttctcgagcagtccgtttttcgtgccagaacattaaataattcatcgttgcagccaaaataacgacgccaataacaccaattttttccggcaaaccaggcatcattatggttaaccctaacgttgccattacacaaccgagggacagtatgattgtcaacaaattagtaacgcctgcgtgtttgacgaggtaacaacagtaactgattccaacagttaagatgcttaccaaacctcctacaatcaccactatctatcccctttcaatatcatcaaaccttatagatcaacaaaccgcactttactgctaccatgaaaacacggcacttttttacttctatttataatttacacccgttaattttttcagtgtccatgttagctctataaaacgtcacctcatcataacacagcttcattatttacaaataaagtaatttcactatcctctttcaacgatacatggctactaattaaacggtaatagcagtcatacttagcatagcatcaagagtcacatcgaattaataattcgaataaactaaaacaacataaaatggctacttcaaaaattataaattagtttttgaagtaaccatttaataactcgtcaaaaatacgggcgtactcactttattcaactttccataaggttttaatacctataacgagtcaataccaacattattctatcctattttcccatgccgataatgccgactcccggttcgccggtccttacgccgcgtaacttttgacagcttagccgcaccattgacggctgagttcatcatgcggtcaaactgacgatcactcaaccactgacgagccgttaatgagacccccgcgcccatacctgcgtgatagcgagtcttgggcttcacatcattgacagcgcgaaccatcagtttagcaatcactcccggattggaagcaaactgatcgaacaatgacagcatcgcaccgaccttaacggcttgttcatgataggctgtctcaccggaaactgccaacagctttttttccgcaataccagcccattcagtcttgattccaccaggttcaacgatgacaacatctataccaaatggtgcgacttccatccgtaacgaatcgctcatcccttcaattgcgtgtttggtccccatataccaagcacttaaaggctgatagatctttcccccaattgaagaaacattaatgatccgaccacgatgttgtgcccgcatcaacggtaaaactaattgtgtcaaccgcatcacaccaaagacattgaccttgaattggtactcgccttctgcgaccggaacgtcttccaaggaaccgtatgagccataccccgcattgttgattaggacatcaatgcgcccctgttcgacctgaatcgtcttgacagccgcgattaacgtcgcttcatccgtcacgtcgacttttaaaacgtgcactccagccgctgctaaatccgtcattttttcaatccgccgtgcggctccgtacacaatgttcccctgagcttgtaacttcaaagcagttgctttaccgatccccgaagatgcgcccgtaattaagatgacccgtggttgactcataatccgttcctccatcgttaactgtatttactgtcatgctacgtcaaacccttcacaattgcaatcgaattcattgcccgtagtatgctaaaatagaactaatttcaagcacgtcaatttaattggaggaatgaacatgtcaacaaagattatcatggacactgaccctggtattgatgatgccgccgcaattacctttgcgttaaatcatcctgacttggacttacaattaattacaacggtcgccggcaatgtgacggtcgacaaaacgacgctgaatgcgctcaaactaacgcgcttctttaacagtgacgttcccgtagcgggtggggctgcccaaccgctgatcaaaccgtttgaagatgccgtccgaattcacggtgtttcaggaatgccgggttacgacttcccgactgaccttgcggaaccattaccagaaacagccgttgaagcgctccgtgactacatcatggctgctgaacaaccgattacgttagtgccaacgggagcctataccaacattgcgctcttatttaagacctaccccgaagtaatgccacacattaaagaaatcgttgcgatgggtggggccttaggcaagggtaatatgaccagcgccgcagagttcaacgtctttaccgacccgcatgcggctgaaatcatgtaccaatccggcgttccaattaccatggtcggcttagacgtgacgatgaaggccctcttaacgcgcgaatcgattgaacagttaccggccctcggtaaaactggcgaaatgctccacgccctctttggtcattacaacgaccgcaaccagactggcgttgcgatgcatgatgtcaatacgctcttctacttactacatccagaagccttcacgactgaaaagatgtggattgatgtccagacggagggccccgctaatggcgagactgttggcgatattcgtggtgcttaccatgacggcaaaaccaacgcgaccgtttgtgtcgatattgatgcggctgctttcaacaagtggttcctagaaaccgtggcagccattgaccaacctaaataaaccactaccaatcgtcattaattaagctaaaaaatgaaccacttcagcttgcacaattatcatgtgcgcttgaagtggttcatttttaatttgtgtcacgcttttatcaagacatagcgctactcaaagtgcttaatacgctcagcaaccactgaccgtacctgattaaatgtcatccggcgtatctgggattaattgaatcaatggttgaccgaagttgacttcttcaccattcttcactaggaaggctttgaccgtccccgcttgcttagcaaccactggccgcatcatctgcatcgcttgaatgaggccgacttgttgaccaacgctaacgtggtcgcctaacttaacgtatggcgcttcttctgaagaatgcgctgggtaatagattccgacgaccggtgccgtcacgcattccttaggatcaatcggcgctggttctggttcaggatcaggtgttacaacgctcgtcggattgctagccgtactggtcgccactggggttggttccgcctccgcaacaactggggtactaactgttgagaccggtgtcggtgtgaccggcgttgggtcaatcaccggctgattgggaagtggcgccggctgcggggtcaccgtcgtcttgccgtgtcccttcttacccatttgaatttcaaaatcttggtcccgatactcaaaactagttaaactgctttgttcaaacttgtccattaactgataaatcttatctaattccatacaacaccctccaattaatttacgctttgattataacgcatagtttagcgcaggagtgtggtggaagtatgaacgcttctttaagaattcgtcaatatttcgtttaagcagacgccaactcatgatccgccggaactaatttaaacaaaaataatggtgctggtgacttacctgcctgcgcgtacgctaacactgtatcaacgtggtctagctgtaacaaccgatcatcaagttgccacaagccgcgttggtaatagtcgcggcaatattgcacgaggttggtcaaaaagttaccgacggcctcattgaccgtcgcgccacgcccatcgacaccccaaaaatcggcggattctaaccagtaccgttgttccgataattctcgataacgaccaacttcatgaattaacactaaccgtgctgtcattgccaaggcccctttcaatctcaatgccactttcataatgacatctaagatagcaccgataattagccctgacaatcctgaatggcaaacccgtttcaaattaaggttattaacgaaaatcgccttgtttttcaatcaagtgacgctttttacttaagattctgaatcttgttcgtgttgtaaaaacgtgccatggtggttcaggtcggcttgtaaatcagccattgtaaactgatgatagtaagcccgatattgacggtcagctactgtaaataaatccgtcaacgtttcactaatattggccgcaatcggggattgatcagcctgttcatccgttttggatggtcccgtaatgaagcgcgcatagctaattgttggggggatggtcaaatcatatagatcgccgaggttcatatcggccaacgccaagtctaattggtagcccccatttttaccaaccgtccccgttaaatatccatgcttatgtagaactgataaaatattgcgaatcatcaccgggttaagatgcagtgactgcgcgagttcccgactagcgaccttactatcacggtgtgcatcaaggtacaggatactatgcaccgccaccgaaaaatcaagtttcatgttacttcctcccacactttgtcataattctattctaccaccaactgtaatgactctcatttcaattagccccaatatgcaggtataatgtgtttgggagtgaaaaaatatgtcatctacaatcagtgccgcaacgttcaagctaaatgatcaagctgcgttgtcaccggcacaacaatcattagagcaccaactattaacttttatccgtacccatcgccagcaaaagcagcccagcctctttgttattcatggtgatgcaggaactggcaagagtgccgtattagccgccgcgtttgctcggctacaagccctcaatcgtagcttgacaccaaacgatttgcaggccactgacaactatctcgtcgtcaatcacaatgaaatgctcaaaatttataagcgcttagctggtgaagatcccgtcttgcgcaaaaaagacttccaaaagcccactccgttgatcaaccggttggcaaaagaacaccggcaagcagacgttgtttttatcgacgaagcgcacctattactcacgcaaccagaccgctataaccgctttacaggtcacaaccagttaacggaactgatcaatcatagtcgcgtcgttgtcctcgtcttcgacacccgtcaagtcttgaagttaaagagctactggcacagcaacgatctcaagccatttttagaccagtacccgcacgcgaactacaacttagacgagcaatttcgggtcactggcggcgccgatgttgtcgactggatcgatggttttacccgcgggcaattacaaccaaaacccgttagcgataactttgatctacgcttttttgatgatgggcaacccttatacgacctgatcaaacaacgcgaccagcagtatggactcgctcggatggtggcaaccgctgacttcccgtacgtcgttaatcatggcacttggtacgtgacggccggacaattgaagcttccgtgggataaagtcaacttaactgatgatccttgggccttacgacctgagacactgaatgaagttggttctatttataccattcaagggtttgatttgaattatgcgggggtcattctcggcccttctgtgggctatgatgaagaccatgatcagattgtcgttcgccctgaacgctatgaagatcaagaagcgttcaaaaaccggacagacttaggcgatctgcgtccccttaaacagcagattatctttaactcaatcaacgtcttgatgaaacgtggtcgttatgggctttatatttatgcggttgacccagcactacgccagcgactattagcgttataataagactaattacacgaggagggatttgcaatgcaactatcaattccgaccatcaatggcgcccttgcagccacctattccaaacaagcggccgttgcccaaacgtataagggccaccccatcatctcgtttcccgttgacattagtgatgtgccagctggcacccattcactggcgttcactttcgttgaccacgatgcaattccggtaggtggcttcacctggattcattggattgccgccaatttaccggcaaccacgacccacatccctgaaaatgccagtcagaccggtgctattccgatggtccaaggtaataattccacagcgggcgcctatgttcacgagactgatccgaaagttagccaacactacgtcggcccgtatccgcctgacaaggatcatcgttattcatttaaactatttgcacttgatactgagttagacctccaacctggatactggctcaacgaatttcatgatgccattgccggtcacgtgctagcaactgctaaaacgacggtcattggcaaagtgtaatccaatctgccatataatatggatagcttaaacaaccaaaaacgttgctacagaatcacgtagcaacgttttttattaacactaatataatggcattacttcaaagaaccggctaagcaaaatacatcagaataaacgcaattaatgccggtagcccctgaatcacgacgatcgcgcgactgacagtaatactaccataaaccgcggcaaccatcacacaggctaagaaaaacagggttgcaccggcgctcgcgacggccggaatcacaaacaagctgtataaaataccgacggccaagaaaccgttatataacccttgatttttaaacaataattgcactgacggcgactgtagcgtttgccgtggaattccaaacgcttttgcggccatttcactatccgcattaaacatttccagccacaaaataaataaatgttcaacggcaaccaagatcgccataatcattgctgcaacgtgcatcctaatcccctccttttttcggtccttacttgaattgtaccagttactgcgcctaaactgtagaaatacagacttacttgtctttatacgagctaattcgtcacaaatcatgattaaaacatggtaaatccggggtcaaaaccgccaccgttttgaccccgaggtgcttttaaatgataaagcccggctacgaccaagcagataacttgctggttgcaaccggactttattcacatctcatcactaaattagcttaatctacacttacataccgggcatccaaacatcttcgggcttgatgccttgttccttcgcaaaagcattccgtaaggtgtccatatccattaaatgataagtttgtgggtgttggggatcatatgattcaatttgggccatcataccaccatcttcatgttcgatgatatggcagtgatacatgtaaactcctgtcagctcaaatttgaccttgatccgcaccgtttcaccagggttgacaccgaccgtatccttcagcccatgttcattaggataaactggaccatcattccgtgccaaaactctaaactgagtcccatgaacgtggaatggatgaaccatgccgttttcagtactgttggtgttgcggatttcccaaatggcgacatccccaactttctgccgagcgtcgatgcgactcatatcgaatttcttaccatccagcgcgacttcatcatccatcccatccatcgtgattgtgcgaacaggtaagtcaggtgttggggtttcatcaggaatatcaactaaatgttctggtagtttggtgtcatccggtacgaacgacttgattcggaagcgacatagcggcgtatcatccgtcatcagcgtgacttcatcgcccggctgatactgaccgaaatcaacgacaatttcgtcccgttccgcacaggtcatcatcactttagtcatataaaccggtgccggcaaaatgccaccatcggaagcgacctgtgcaaattccaaatcgtcattgaagtgcagacgccattcgcgccggttcgacccatccaagattcgtagccgcacccgctgcgtcgtcacatcaaaatatgggttgaccgtcccgttaactaacgccgtatgcccttgaacaccatctggatcgtagtccgcccggtaatcaaattggttatcatcgtgaaattcacggtcttgtaataccaacggaatatcatccacaccataattacgtggtaacggtaactgatcttcaacgtcatccttaataatcaccatcgttgctaggcctttccagacctgcgtcgcagtcgatgggcacggatgagcatgtaaccacgtagtcgcagctggttgatgtactttaaagtcaatgtgattcgtttcaccgggatagaccggtgcgtggcagccaccatcggtaatgggccctgggacattcaagccgtgccaatggaaagtcgtcaattctgggagtttattttccaagtcaatatgggtctgcttaccattacgaaagacgatagtttggcctaggaagcccgcattatagccccacgttttagtcttcttaccaggtaaaaactgagtttcgctttcttgcgccgtgacggtatagtaatcatccgtatccgtctggcggtccggcttcaataacggcggaatcgctaacggttgtggctcgactttcggtgtaactagtggaatatagccaccgtcatgtgtgttgtaagcaggttcatcaaaaaaataatcagtatagactttttttgccatgttgacatccccttagatatttaaaataacttagattcaaaaaatggtggcgcttttatacgtcaccttcagtttagaattattttaaaaaagtgtcaaacgaatttcagcattcgtttactggttactaaggtcgtccctgatgacacttaaaatagcgctttgactgtattcgtggtcgcatcacccaaccaagcattcgtcaccaaatgatcaaaatagctcgtttcaacaacgccagccaaagttgctaattcaacattcaggtccgtaagtttggcatacgttggaaaatgacaatcgatcaataaattgccgctatcggttaacgtgaagccatcccgattattagcagttcgaatggttgcctgaccaccaagatcactcaccgtccgcatgactaacgataaggccgctggcagtacttctaagactagtggcgtcttgatatcaaattgatcgactaaccggtcctgcatcgttaacagccaatattcatccgccaagctggcaataatcttctcattagcatggattccaccgccacttttgagcgcgttaccgtgatgatctaactgatcgcagccgtcaaaagcaatatcgacgcggtcacaatatgcagtatctacaacggtatacccgagaacggtcgcaagttggcgggtcgtcggtgatggggtgacgaccgtaatatcattcacatgattggctgcctccttgaccagttcaccaaccgtcgagccacccccaaaaccaacaaccatttgcggttttattaacgtcaaggcttgttgaacaattgcctgtttaatcgtcatatcaatttccttccatcatcataagatattctcatcatagcacgcgataacctatttaactaactttaatcgcgatcaaaccatgcgattctaggtcaaatttgagtctaggatggggctcctatctcaacaacgttttaaaatacaattattgatggcgaccttcgtttttgggggaaagagggttacaacaatgaagaataagtacagtgctaagttaggtttaaccacattaaccgtgatttttggtcttgggctgacaccaattgccaacgcaaaatcgattgcgacaccatattcacggagtcgctggccacacgctcaagtgacctacgtcattcaagcatcatcatacgagcggcacgtctatcaagcggccatccaagcctggaatgcgactggtcactttaaattcgtaccgggaaccactgctcatcatcaaattactttggggaccagtaatgccaccagtgggcagtattatcgcttagccggtattactttttcgaccggttataccaatggttattacacaaaagcgcaagtgtacttgttaacacgtaattttgtacgctaccactattcttatacggatcaagtccacgtggctgaacacgagttaggacatactattggtttggaacacagccgtgatcgccacagtgtcatgttagctgataatcgctataacggtattagtgcagccgatagcgcggcggtgcgtctgcgttaccgcttacctgttggcaggctttaggtaaagctatccaactaggtctgccattaataccttgggtgcggtgaccccactttgatgtttacaatcaataccgcacccaggaaggccgcgatgatgagtcgcgaccttttttatgagcaccgatggccgtaatcatcgttgaaacataacttaaattagcacgctaaaaatgattgcagacaaaaagcactttgatacggtcgattcctcgtatcaaagtgctgcgcttagctgtgcagtaaataaccatagcttcctaaaataactagtacataccctgtagccgtgactaatgctagcaacatgccgcttccaggttgccacccgcggcgatgacaaaaagtcaaacagccactggttaacaacattagcgcaaacgttgctgcgatgactccgaagaactggccccattgaccaagcaaggcacagcctactcccaaaatcgtcgcgatcacaatcacgaaccaccgttgccggtttgttaattgtcggcgcatattcatcccaccatatagttaatgcagtcaacgttctgcttagtaaaattttaacattttggtagaagtttgccaaacaagacaattaacaaccgtcactttttaggcttgttgacgtttttttactgattgatcgcttaaaacgtcatcaaaggcgtggaatttctcgataatcgtgtccgctgaattacggaacttagcttgttcatcagcagtcagagcaagcgtcgtcacactctcgaccccatctttgccaatgattgctggctgaccaacatacgtcccaaaggtctcactatacgcagagaccgggcatgctaagcgagcatttgcaaagaccgcttcacttaatttaaccgcgcaagtagcaatggcaaaactggtataccccttaccagaatgaaccgcccagccaccatggcgtgcagctgcctcaagtgcatctaagtccaaatcatacttatcaactaaggatgtaattggaataccgttaacctgaaccgttgaccacgcgctgaattgtgattcgccgtgttcaccgtaaacatacccgctaatgttttttggatcacagtcgaaggcttctgcgacaaccttttgcatgcgcgccgtatccaagaaagtcccagtcccaaagacctgttggcgtgataatcccgttgcgcgttggaaatagtgagtaattgcgtcgcacggattcattgtatcgatgaccacgccattaaatttggttgctttaactttcggagcgatatcttgaacgatttgcttcgtatattcaaattcagcccatcggttaccggaagcatggtctaacgcgtgaatgttgccactagtaacaaataaaatatccgtgtcgtctaattcatgatagtcattgattttaataatcgttcgactatctaaacgggcttgagcgtcttgtaaatctaattgctctgcgcgagctttagccgcattagtatcaatcaagactaattcatccgcaattcctttacaaactaatgtataagcaatggtcgccccaacgtggccgaccccaataatcgcatattttcgcataagctgaacccccgttttaattattaagacgttatgtaataatctcatcgtcttttaatttatgtggtgataaccttactgctctagttagtaatggtcaattgctgaaagcgcctcacctttcatatcatcattttcttaagcaatagcacgcactatagttaccaattcccctaattagtttaagataattaatcacttgccccccattgcctaattattttcattaccgaactaatcgcgaccactcttggaagtcacttcctacatttctgccaataagcaaccttgaccggcttttgctaagaatttacaaggagtccactcatgttttcaatagtttgcgtcacaaaatctgacatcaacagttccataatgacaccaaagcccgtttgtaagtttaatatttaacctaaacacaaaaaaagagtgcgtcgctcaataatcaatgttataatttctaacatcaaatggtatggataggggttgggagtatgaacgctgcaaattcaacgtttttagtgttatctagtatattggtattattcatgacgcccggattagcatttttctacggtggcttagtttccaaacggaatgtcgttaacaccatgttatccgtcttcatgatttgtggcttagcaatcttgttatggctcgcattcggttattcactatctttttccggtgatttaggtggctttgtcggtaatctcaaagccacttggttgcatggtgtggacttgaccgcgcttaccgcgacaaagattcccaacggtttatatctcatctttcaaatgatgtttgccattatcacgccagcactatttgttggcgcggtggtcggccgtatccgttttaaattcttattaaccttcatcatcttctggtcactcctcatctactatccaatggttcatatggtttgggataacggtttattagctaaacttggcgtcatcgacttcgctggtggcaccgtcgtccacatcaatgccggtatcaccgctttagtcttatcagccttcttaggtgcccgccacaagtatggcaaggatatgacccagcactataacatcttatgggtattgctggggaccgctattttatggatcggctggtacggtttcaatgccggttcggcgcttgccatgaacgacatcgccatccaagccttcttaaccacgaccgttgccaccgccacttccatgatgacgtggatggtcgttgatatgctaaccaagggcaaaccaaccctagtcggtgtctgcaccggtaccctttgtggtctcgttgcgattacacctgcttgtggctacgtcaccatttctggcgccttttggattggccttatcgccacattaaccagttacggcttcattacgttcatcaaaccacgcttaggtatcgatgatgcactcgatgcctttggatgccacggtgtttccggcatggtcggcagtatcatgactgggctattcgctagcaaagccgttaatcgcacaatttctctaaacggtcttttctatggtggcggctttaaattattcggattacaactattagcaacgatctttaccattggctttactaccatcgtttgcatcgtcattatcgtactattgaaacgagtcatcagaatgcgcgttgacgagcgagaggaagaactcggactcgatcaaggcgaacacggcgaagtcgctgactacaccgttcaaatgagtcacgacttgacgaacattcaacaccatagcgatgaatttcgtggtcagttagcgcaactgctagataagcaacaacgattccgataatcggaatcatgggcgtaatatgcacaggtttcagtgcgttcgagaaagcagtcgcatggcacatttctatcaatgctcagtatcacaagcgggcataaatcagacgggagaagactgaggattagcctaactagggaattaaacgacgagtttggcgtcataacggcgctaatccgagtttttttcagtgagcttatgccctggatctttaaaacaagcctgatttaaccagaccccatttcagcaacatcaaggatgcaagaatataaaaacgtgtcgcaagaaatcatctcagatttctcgcaacacgttttttgatttgctaatgtttacttggcaggtgccgtgcgtcgatgttttagtaaccgcccgccagtaatgaccgtcgcaactaaacaaatccctaacgagaccacgaacgcaatgtgcataccatcaataaagatctccgggtgagctggcaggtatgacgtaaccttataccccgctgattgactcattgccgaatatagtacggtcgtggcaaccgaaattccaacaatcatgcctaattcacgtgccaacgcgttaatcccgccagcaacgcccaagtctttgaccgccactgaactcatcacgatcgaattattgggtgccatgaagataccattgccaaatccaactaatccgacgaataataagaagaaccaaagtggcgttgctagccccacaaccatgtaacccacttgactgattgaaatcaggaccaatcccacgaacgttaacaattctggtccgatcttgtcagaaatcgtcccagcaatcggggcgaccaccacttgtacgattgggaataccatcaaggcgtagcccgcatagtttgccgctagcccccgagcattttctaaataaaacggggcaatcacgttaaagaaaaagttcgcaataaaaattaataacgcacataagatactaatgctaaaacgggcattcttaaataattgtagcgctagcagcggattttcatgacgtaactcgacgcgaacaaaaataatcagcgtcacaattgccactgcaaacaaggctaagataaccggctgcaagaacccaatctgttgcccgataaacacacctgcaaatagtgcaaccatgagtacggcaaataaccccgccccggtcttatccaatggttgttgcgtcgtcgtgacgtcttttggcaaaatcattgcgcctaaaatcatcgccaagattcccaccggaacgttgatccagaaaatatagccccagctcaaatgagctaggatcaaaccaccgataccggggccagcaatactccccaatgcaacgaatgagccaatcatacctagcgcccggccccgttccttaaacgggaaaacttcggtaataatcccgttgttcgtactcatcgtcattgccgctccgactgcttgaatactgcgtgcaatgagtagaaatggcaaccccacactgaatcctgacaataacgagccaataatgaatagtaaggacccgattttaaacacccgaatcttaccgtaaatatcacctaatttaccaaataataacaataacgcacaaatcacaatcaaataaattgagacgacccattctgcctgattcattggaatcgctaaatccttactcattactggcaaggcaatgttcacaatactcccatctaacgttgacatgaacgtaaataaacataccgcaaccaatatccaccagcgatgcttttgaatttgtggatcagtcgcaaacgacattgttttcatcccttaacttcccctccattgcgcaactggcggtcaagccagtctaattgtgcttgggctcgtacccgttgtaactcattgaccatcaacgcatcttgaatatcagcggcaagcatgtgggtattcgtcatcacccgtttgtgctgcgccgttaagcgtgcgacctgtccctgtgcaaattgctgaaaatccaacaagattacttgctgctgatcacaacttaataaatgtaaaaaattcagctttatttgaaacgttaactgcgtttgcttattgagcgcgactggcgtcataactaactgccaaaattgcgtgcgaccagccgctgttatcgtggctaacttttgtggccgtttattagtggtccgcttaaacgccagtgttaattcttcagccgcggctaacttatctagcaacgggtacaacgcaccaaaactaatggttaattctgaaccaactacgtttaccagcgctttacgcaactggtagcccgtcatcggatgatccatcaactgtcctaaaataaacaattcatacattaaattcaccaatccttcgcgctgttaagtatatatatcttttagatatattgcaaggttccaaactgattttttaattatgcccctccgttaccgaataacccagttcacgtttaatgctagattaaaacggctaaacatcagtgcttctcaaatcgatttttaggcaaaaaaatagcacctctcaggacgacatcatcgttcgaggtgctatctcatttaatcatcacttatgtttcgattttttatccttaataaagaagtacccgaatactaacatgaccccaatagccggtacatctaacgcattaaaggggttctgaaattgcggtgcggccaaaatcaccaatattgcgacaaaacatagcccaattaaccaccacccgtatttttgaaagaaacggataaaggtactgtctggaaatttgaatttgatatattgtaataccaatattaatagcacataggcgacaacatttaagaatagtggcgtatccatgatatgaccccctttatgctctagtattaagataacccaccaaatggtattccaggcggaaaataatctaatgcttataacgaatataactagattgctgaagcattacaaaaaatcaagcttaatttaacccgaaaccaactcataaattgtgcattgaagtttagacattttcctttcaaatcggtagtacggtcagcccaagctcgtcccctcgaataaaagcatcagcggcccccagtccgaataatgtgcgacgttgtattgtactttattccaaccaaagccgtcttgaatgcacacaaaaaatgggtgattgccatcgcaatcacccatcgatattaatgttaatttaatgcaaccactaaccagccgccgtcacttactattgaataagactgactgacttttaatataatgattgactggatgtaacagtactgtcggattctcaatcgccgaagtaaccgagtgacctgaaacattcactaacgcaaagaagacgaacaggacaattgccactaacatgacgagcttggtggcaatcgtcatcttttctggcaagatttgcttgtatagcgtccgatgaacttgacggctaactgcctgcttactcttatcgctatccttagccttttcttcgactaattgtcgttcataagcgacaatgtcaaagtccgcttgttccttcttcttaccgacctgatacttcttacgataagccgccgtttgcgctttgaaatccttagagaatttccggtaatgatcaacagtttccttggtctcgccgacttctaaaagatccccaaagtgcatccaagcgacccggtcacaaagtaattccacttgccgtaaattatggctgacaaagataatggtcttcccttgcttcttgaattccataatcttatccacacatttttgatagaaggtgtcatcaccaaccgagagtgcttcatcaataatcatgatgtcgggattgatatgcaccgcaatcgcaaatcccaatcgtgaccgcatcccggtcgaatagtccttaactggttgaccaataaaatcaccaatatccgcgaaatcaacaatatcatcacgaaccgcttggatctctttaatactcaacccttgcatgagtcctttcaaccgaatgttttcatcaccggtcaaattccactttaagccggctccgattgaaataatggacgtatcaccgtgcacatccactgtcccagtcgtttgaggaatgattcccgaaatgatattcgaaatcgttgacttaccagaaccgttgattccgataatccccaacgcttcacctggtttaacgtttaagctgaccccttttagcgaccaaaaccgcgggacatcaacattaccaatgttaaaaaagtgttttaacttatcgttgttactacgatataaatcatattctttagtgacattatgcaattcaaccttatattgattttccatcagttccgcctcctaaatcaaatccacaaagttcgaacggaacttgttatagagatacgttccagtcagaatcacaacgagattgaagagccaaaagacaatcgtcaacgtgatattaggctgttgccagatccaaccacgattaagcagcgattcccgcattccgttgagcacgtagtagaacggatttagttctagtaggcgcacaaaaactgctgggaagttggacgttgtaaagttaaatagcaccccactcatatagaacagcatccgcaatacggattgaagcgtgatatgccagtcacgaatcagaacactgaccgtggcattaaaaatcccaagtgaatacattaatacgatcatacaaccaaagtagtagataaattgaatccaagaaactgagggccaaatgccattaacgaacatcaggaagattccaaaagcaatcatcgtccagaaactatataagttaccataaattttaattgacggtaatacgttgactgggaatttcatctttgaaactaacccaacctgacgataaatgctagaagacgcgtccagcgtcgttttgttcatgtataaccatggtgcaatcccgacaaccatccatggtaaatacgggattcctggcatcggatcgccacgttttaacgcgaccccgaatactaagtaataaattccgatttgaatcagtgggtttagaaattcccacgctaacccaaggtaatggctttggtatgtggcccgatcatcatacttcgccattcgccgaataatcttgaaattggcgaactgatcgccaatcgtcttaaacatcgtaaacatagtgcactccttaaatgtatgtcgcaacacgatcaagcgcctcttgaaaggtcatgacagatttacggtcaagataaaccgcagactacattataacgataaacctcgttaatagcaccgaaaataacattttttattaaatatttacctattatcaatagatacttattgaccgatactcctatttcacaagcaaagaaagcccttacatacgttgtgttttaaaaaaaccgtatgcgtttattttggcaatcatcatttgaatatcgaattgcactttaagatcactagccgtgaacgcatcatcggaacactattttttacgtagcgatgaccagcaccgtgttgtgttgcacacataccaaacagccgcactcaatgccggtgacagcgtccgggtgcaagcgaaaacggttttaaatttgcagaacaaggcccttctaatgagatgagcgacctgaatagcacgtgagcatccgtttacttacctagtcataacacacttaccaaaccagctgaataatgacttataatggcgtcttcacctcaaaaagtgctatgatgagggaacattaactaagggggttagacacgatgagttcaattattgagaatttacaattagccgcacaacaggttcacctcatcaacctatatcaagccaatagcgaagtggtttacaccggctacatcgaccgtctggcacctgatggcgttgtcgtgaatacttacgatgatgctgggctccaggacggcgccgtcttcatgcgctacgacgtcattgatgaagttgaaatgatgagtgaagaccttgataacatggcctttcgccttgaaaatgcaactactgaaggtttgaacagtgtgccacaaccaaccgtagctttagacgatcaacggccagtcctaacacagttagtcacccaagcccaaaccgatcatcaagttgtgctactagtcctcgaagacaacgaaaattatttagaaggtcaggtccaacaagtcactgaccaaacgattacctttaaaacttttgacaaatttaactttaaaaacaacgggcaacaggaaattccattggctgctattcagatcttagagttctgcggcaatgagctcttattggaaagcgcctttgtcaagaccatccatacgcatcgagcaaccatcaaagttagcgagtttgacgacgttgatcatactttaaacaacgccttaaatgagcaccaactgattgcaattcggtcagcggacgggtctgacatgttctttgttggcttcattaacgcattgaacgctgatagtgtcctgctcaatctgatcgatatgacgggccaatttgggggctacactctttgtcgccgttcactaattgaatcggtgacaacccagtccgactatttacaaacgatgcgtggctttattgaattaaatcgccagtatgagttaaatgttcaacccgtcttaaacaacgaacggttatttgacgccacaactgatctttttgattcaattttgcgacaagccgcaactttcaataacctcgttcacatcacgacagaaaaccccatgttgccagcaatgactggctatccgggaacgttaacgaacgggcacttcatcttctataacgtggatgatgataatcaaattaatcatgttggcacgatgatcgaactcgatcaggtcgttgaattatcctttgggtacatggacgcgtacctgttagagaagcggttaaagagcaccggtaatttataataatttcaatacctcgaatcaaaataacgcaactggcatgtgaatgctagttgcgttattttgattccgttattacagctcaatatttccgagcaatcaagaacgagttgcgcccccgttgcatgaattatgctcagtaagtgattggctgtcatcattaatgctaagaggtcatcctaacgatcgaataagtgcagttttgcaattcgctgacaggcttccgtgaagcggggttcatcaatcaagagtccaacgcgcacatagccttcgccacccgcaccaaagccgtttcctggcgccaccgcaaccgccgctttatccaacagcaaatcggcaaatgcttcactggtatacccttcagggactggcatccaagcgtaaaatgagccccctgatgggtagggctcccacccaatcttacgggccgccgtaaagaactgattacggcgtcgttcatacagcccaaccagttcgtggaccgtctgttggtcactgttcaaggctgcaatcgctgcatcttgaatggccggaaagacgctaacaaacagatgatcctgaatcaaatttaaggcttcaatcatgtcagcattaccagcggcaaaaccaacgcgccagcctgccatgttaaaggacttagatagcgtgtacatctcaattccaacgtctttagcccccggtgtctgtaggaagcttaccggtcgctgaccatcgaacccaattgcaccataagcaaagtcatgaacgataccaatctgaggttcatttgcaaaatccaccgtgtcttgaaaaaactgcgacgttgcgacagcaccagtgggattattcgggtaattcaggtacaacagcttggccgccgcagccacttgtggatcaacctgctgataatccggtaagaaatgattggccgctgttaaccgtagcaaagccaacttcacctgtgccaacgtaataccagataaatagtctgggtaaccggggtcaggtaagatcattgtatcgcccggatttagtaaggcaaagggtaactcgaccaacccaatcttactgccacccaaaacggcaatctcagtctccgggtctaatttcacaccgtactcgcgttcgtaaaaatcagccgcggcttgtttgaatcgcggcaaacctcgaaacaacgaatacttgtgatccgcgggattggcagttgcagtctgcattgctttaacaacaaactcaggggtgggttggtcaggattgccttgacctaaattaatcacatccgcaccggccgccgctttggcattgacctttttgaccagattcgcaaaaaactgttttggtaattgctgcaaaattttggactcttcaaatttcaaaattagtgcttcccttctgtcaatggttgtcagtactaatttacaatcaaccataatctcaagcctaattatgagttttcaattagaatatgtcaattttttaattatttttcgattaatcactgaattaagccaaaactaccaaaaatacgtctcaattttacttttcaaagtaaacctggtcatgcaaccgacaccgcgggttaaatggtcggtgacagtgcgggcattgcccctcatgataccgatcaaccgtcattcgataacgacaagcaccacacatcacggctaaatccgtcggagcgctggccacaaaagtatgctggcacaacgtatcatggcaccggtaacacgcgtaatagtgttgacatcgccgacaccacaatgccgcgatatcagtttcaaggtgataatgttggcaccgaccggcagcgtctaaaccgatgccgtaaatcactggtaaccactcagtcatactggtaaccctaccctgatcacttcaccactcgtaaatgtccgccgctccccggtcaacatgcggaccactaagccaccatgttcatcgatatcttcagccaccccattcaccacggaatcgcccacttgaagtgtcacttgttgacccaacactaatgatttagcccgatatgctggcaaaaagtcggccgtagcgtagcgttttgatagcgctactagtgctgataataaggccgctgctaaccgattgcgatccactgacatgctcgggtcgaccgcttgggcacgagcttgcaattcccgtggaaaatcggtggtcgttaaattgagccccacaccgacaataaaggccgttgcggaagtcgattctaattccaaacttgcttccgtgataatgcccccgaccttatgctgatcaagataaatatcattgacccatttcaacccaaagttcttattaggataaaattgctgtaaaacattcaagacactcaccgcgacaccagttgtcagtaaacccacattgaccaatgcattcgtgggattaggaacaaccaagctaaaatacagtccagttttggccggtgaatagaagtcccggcccaaacggccatagccagccgtctgttcgtccgcgaagaaggcggcaaactgtggctgatgatgacttaaaaagctcttagctagaatctgagtggacggcgtctgggcgaccacttcaaggggccccgtaaattgacgttgcccatagatttgaatggctttggcatccaaattacgacttcccagataacagtagccccggtttttacgactctcaatctggtgtccttgctttctcaaagcattgattgccttccaaatgctctcacgactacagccaactgattgggcaagctggtcccccgattgccactcaccatgatgacgcaataaaattgttaagacctgttctttagttgtcattatgacctcctgacctgccaatcacattagctatttactaagctggcaatccaaaatcaacgatggcccgcacacgccgggcaataaatacggccaaagtccctttaatgatgtcaccaggaagaaaggccacgttcgacagcaaggcggccgtcaaagtcatatgagactgaacagctagccaactagcaccgattacatcaacaaataagataccagccaaccagacaatgccaacttctagccaccaataaccacttgtcatcgcccgagttattttgatcaacgttccaatcagcattggtgccagcaaccaagcaacgagatagccacccgttggcccgagaaaaatcgcggcacccccacgccccccagataataggggtagtcccagtgccactaatcctaagaacaatccaactgcgatcgtcccatatttgcggccaagtaactcggcggctaaaaagatgcccatattctgcaacacaatcgggacgggaataaagcccactggaattcccggaaagaaacctaatacaataatcaaagcggtcaccatcgccgtctgggtcaggtgtttaatcgtctgtcgattcgtcatcatcgcacccctgttaatcaatttaaacgctattataaaacaacagtaacccaatatcaacatcatgggttactgtttagaaaataaaaaatcccatgaccctttttactgatcatgggatgattgaactattcttttggaatacgcttttcaacgtgatattgacgtgcttctggtcttggcgtatcggctgtcagtaagtcatccgcgtaaaaaaccgaataaccgtgatcctgttctagcggccgcgcaatcatgagtccgcgcttacgtccgtgacgcgcattataaatatccgcactacggagcgcttcattgtagtcatgcgattctgaaattgcgtcaccaggattaaataagacattttcatccatttgccatcagctccttgtccttttaataacctaattatacacgctgataccgtcataacgaaagtttaaagattgatatcaacattataggttagtttcgagagcgttaaacctttggtgactaattgaccaatcaaagcttgggctttatcacgcatctttgcgaccattactttatcttgttcagtcaagaaagccgttaactcgtcaccagataacttcgccgcttgttcatcggtcgcagccacaaattgacccagttcgattcgacattctttcaaataatcaatatcatcctgaacgaaatcagcatagtgtgattcaacaatcattgatagtgtccggtagagccagtaagcactattcatatcatgttttagtggtgtgttcgcaaaactaggatcagtttcagaaacgttcgcatggaatgggaggtatggcgcaaaagctggtaccccaaatgtcatccacataatcgcgctttgttctgctggtacgtcattccgcacttgcataacgtgtgaattctgcgtccgattcattgaaattggccgaaactttttagcttctggtgtattcaagaagggatcgtacttcgtttcgttataatgagaacccagtacaaattcaacgtcggcaactgaaatcttcttggctgcgtgacaaatgaacggtagctcactcgactgtggatcttgttcgatctctggattgaaataacgttggccgtaccagacccggggagtattataatgccggtctttttcattatcagtaccgaagatatgacggaagttaaaaccttccttgtcagggttcaaatggtgttccgcaacaaattcttgaataccatcagaccacataaagttatcgggatcatcaaaatcaacccattgaatcgcaacttggttggcagccaccgcgtaagcatcatccggaatccgttgtgcaacccagtggtgaccagtgacgatctccatgtaccacacatcatctttatcattgaacaaaacaccgttaccttctggcgaaccatatttagcgatcaactggcccaagtattcaaccccaccacgagcagaatcaatgaacggcgtgagcatggttggcaatgaatcttctgcgagaccattaggcacgaatgggtcaaaagtcagcgtatgttcattaccataaacactttcagttgaagaaacaccaacgtttttttcgttaaagccattttcttcaaaaacacccttttcagcgacttcaatgtttggtacagcttggtaacggtagccatccgctggaagtggtgcggtaaagccattcttcccagaagttaacgtttcgttgcgaccatgaacggcgggatggacgataaatttttgcggtgtaatcggcataaacgtatcatcattgcgggcaatcatcgttgaaccatcaacggtcgccttcttcccaactaaaattgtggtacaagcttgttcgtacatgcaagcatctcctgtctttaatttccgtgatcattattaatgatacacgctctaatttaaaaagccaccattgcgaaagcgctgacagataattcttacgcaattttaattgccgataaatttatcaatagtcataaatcttttcgtaatctaatcaataattcttaaatttgaaaaatcatcgtcacattttcttcacaattcgttgttaatatgtatctatagcaattaaggatccccctccaagattgctactataataattaacattcttttcatttactcctccaaagtaatgaaatccgtcaaagcgtaacaactttgacagcttgatgagcggcatgtgaacgtcccccccgcttatatgaataaacgctcatcaagttatcagcatatgattccccgtcatatgctgacctactccttttgaccttcgtattcccgtacgaaggtttttttgtcggcttaaatacttcaagcgctcctttaactccgtattactgaaccgccctctaaaacgagcttatccaaatagttactgagcgatatgcagcatgaattcaccatttatcgccatactttatcaacaatccaaaactcacccactattttataacggccctatcaatctaaccaaaaacagcatataatttaattattatcacattaaaggtgggtcatctatgcaagagggatacttagatcagcgcttaatcggtcagcgcttcattatcaaaccgaccgatctaactgacggcgtcgcattctatggcatcttgtaccatttgcacgccgcaacaccattgcacaccggcgataccgttgaaatcacggccgtcagtgctcatggtctaacggtaacgattatcgcaccacaacaatagggggaaattattatggtaggtatcatcgttgcaattattgtcattctactggtcgttttagtcctaatcgcttccatccgcatcatcacccaaccgaaccaaggtgtcgtcttaacatttggaaagttcgagcgcgtcattagttccggctttcactttattaaaccgttcatctcacgtgtcatcaccgttaacacggctcagacacccgttgatcttaatcaacaagtcgttatcaccaaagataacgctgaaatctcagttaagatttcgcttaagtaccacgtcactaatattgaagacttcgtttttaaaaatgaagactccgttcgtagtatgattcaagatacccgcgcggcactgcgtggtatcattgggaacaaagaattaaacgaagtcctgaatgggacgcaagaaatcaatgccgccctcttcaaggagatctcctccgttacggcgggctacggtttaaacgttgaccgggtcaatattgattccgttaacccttcggcagatattcaggcttccatgaataaactcctgcaagctacgcgggaacgggatgccaccatcgcaactgctgaaggtaagagtaagtcaatcacactggaaaatgaagccaataaccgggccttattagccaccaataaagcccaaaacgaagctttagtgaatagtgcaaaggcgaaagcaacagccgttcaaactgaagcagatgctgatgcttaccggacgcggatcttaaacgaagccttggcacaatcatccgaaaactactttatcttccaaaacacggaagctgtcaaagccttagcggacggcaatgccaacaccgttgttttaccaaaccaaacgttagatagcttgggcttaatcccagcactcaccaaggtcagcaaattaacaactaagtagcttttaatcaggacaaacaatgcacagcctgcaggttgacgaacgccacctgcaggcttttttctgatcaatctaagacctaatcaattttgtaaacctttccgttaggtttaagcgtgcaactaggttagaattagattgtgcaaaaccatacttagaggtgttaatattgaaacaaccttggcaaacagcttggccggaacgaattagttatgggctcagtgatgccgcggataacttagtctttcagatgatgaccacatacttattattcttctataccgatgtttacggcctatccacgagtgcagcggcgattttatttgtcgttgcgcgcttagccgatgtcgttgaaagtctgattatcggcgtcatgattgaccatacccattcgcgcttcggtaaaagccgcccgtttttcttatggtacgcgttaccctacgtcttgttcgccgttttgacctttgtgaccccgaatttcggagcaactggtaaactcgtctgggcttatgtgacctatttagggttaggattcttctataccgccgtcaacctaccaatcacatcgattttaccagcactctcccagaatgaacgtgaattaaccttactaggcgtgattcgtcaattcttcggtagtagcgttcaaattatcgtcgctgtcttcaccttgccactagttgctttatttggtcagggtgatcagcaacgagggtttttactgacaatcgttctatttggcattatttcgttggtactgatcctcaacaccttcttccaagtcaaggaacgctttagtcaacctgagcgtccgcaccaatcactcagtgcggtgtggggcatgctcaagcaaaaccagccgtggtttattttatccagcgtgattttactgtattggttaacaaccgccatcaagaatcaaacgaccatctactactttaaatacttgattcagcgtgaggacttagtgccagtcgttaacggctttacgtttgcgtcactgatcggggtcattttaattgtccggctagccaaccaccacgggaaaaagaataccatgttggcgggtatcgcaatcgccgctgtggggcaactgatccttggtctcgggacagccatcaatcaactggccttcgtcttcggtggtacgttgatcaatgctgtcggtaacggtctcatcattggtttggtctcaatcatgattgctgatacgatccgttatggcacggcgcttggcattcaagcagaaggtattttagcctctactgatgacttcggcgtcaatgtcggcttaggacttggtggcctagtcaccgccggactctttcatctaagcggctacacggccaatcatgcgcaaaatatcgccactcagcatatgattaccctaaactatgcgtggttaccattattactttacgtggtgatgtttatcgtattaattttttacaatgagcagcaattgcaagacgcgattaatgtttagttatccgttcttaacaccaaaatgaggtcagtgaccctcggcattcgagaatcactgacctcactttttccttcattcaattggataccaacagcatcccattaagttacgattattttaacaaaccgcaaaattaaaaatcacgctacaatcggttccccgataatagcaaccagaaaagggtacactgacactggcactcccaggtggtaagtcagtaccaagttccccaaaaaagcgcaggaaaaaagccgaccccgaagagtcgactttttctgaatcaaaaatccaattatttaacagctggagtcttgaaccagccaatccgtgatgtaacaacatcaacgatggccttcttaccaggtgccaataacttacgagggtcgtagcccttaccgatttggtctgcgccagattcgatgtaagcacgagttgcattggcaaaagcaacttggttttcggtgttaacgttaaccttgctaatacccaattcaacagccttaacgatttggtccttaggaataccagaaccaccgtgaagtaccaatggcatcttaacggcttctgagatttcttgaagacgatcgaagtgtaagccagtccagttttctgggtacttgccgtggatgttaccaatcccagcggctaagatgtcgataccagtagcagctaaagtcttagcttcttcaacatcagctaattcaccttcaccgatgataccgtcttcttcaccaccaattgaaccaacttcggcttcaacagagatgcccttagcatgagctaatttgacgatttccttagtcttttctaagttttcggcaaatggtaggtcatggccatcaaacataactgatgagtaaccaacttcgatacattccttggcagcttcgtagttaccgtggtctaagtgcataacaacaggaacagtgatgttcatgctttccatttcatcagcaactaagtccataacgagcttgtagccgcccatgtacttagcagcacccattgaaacttggataataactggggtgttagtgtcttgagcacccttcaagatgcaacgagtccattcaaggttgtttgtgttgaacgcaccaatagcataatggttcttgtatgcgtcttgtgtcatatcaacagcatttacaaatgacataaaataaccctcctaggttaattaagagatacgatttttgaatcacattcattttagcacattttacataggagtgataaccgatttgtcatatttattaaccaacgattccccgtcaattcttgcttatttgacaaccgcccgtttgtaaacccttccatttatataaaatcagttacagatcaagccaaaagttgcttcgaatttaatcaataattaattgtgaatattataacagcaatccgttcggtgaaaatgtaagcgaacagtttatttacatttatatacgctattaaatcaataattatagtgtttcaaaagcaatttatgaaattaaatattagctatttacatttgtgaaaaagtatttataatagtgattgtgaaataagaaacaagttgattttgcataggaggaaccgtgaatgctgaaagaaatggaagaaacaaccgtatcacgttcaatcgatcggttagtcttaaatgcttcgttagctgccaaccgtcttgaagtcatggaccaaagtcaagttgatcaggctgtcgctgccatggcccgcgctgcccacgctgctcgtggcatgctggccgctatggccgtcgaagaaacgggtcgcggaaattatcgtgataaagttgcgaagaacgactttgcagccaaaaacgtttataactacatcaaggatgacaagacggtcggtatcattaatgacgatccagtcagtggcgtgatgaaagttgctgaaccagttggaattattgcgggggtcaccccagttaccaacccaacatcaaccgtcattttcaatgccatgttagcattaaagactcgcaatcccattatttttggtttccatccctttgcacaaaaatcttgtgttgaaactggccgaatcatccgcgatgctgctattgccgctggcgctcctaaggattggattcagtggatcaagacgcctagccttgaagcaaccaacaccttgatgaaccatccgggcgtcgctaccattattgcaactggcggtgccggcatggtcaagaccgcgtattcaactggtaaaccggcactcggtgttggccctggtaacgtgccatgcttcatcgagcaaaccgcagacattcaacaggcagtcagtgatgtcgtcacttccaagtcattcgacaacggcatgatctgtgcttccgaatcaaacttaatcgttgctgatcaaatctatgatcaagttaaacgtgaattaagtcacaacggtgtgtactttgtcggtaccgagaacttcaaggccttagaagcaactgtcatgaacctggataaacaggctgttgacccgaaagtagctgggcaaacgccatggcaaatcgctcagtgggctggctttgatgtcccatccgataccaaagtattagcagttgagttgcctagcatcggtggtgaccaagtcttatcacgagaaaagttatcaccagtcctcgccgtcgttcatgccaaggatactgaggccggcttcaacctgatgaaacgcagcctagcacttggcggactgggacatacggccgccttgcatacgactgacgaagctgttatgaacaagtttgccttagaaatgactgcttgtcgagcattgatcaacgtgccgtcttcacaaggtgccattggttataaatatgataacgtcgcaccatccttaacactcggttgtggaacatgggggcataactcgatttcacacaacttggaagattgggatctactaaatattaagaccgttgcaaaacgcttaactaagattcgctaaagtttcatcaatcaggataataaatttaaaattgccgctaacaaatgcgcccgctgaagtcagtctgcttaacttcaacgggcgcattttagatttatgaccaagttaagccaacttcttaaccgtccacgcatcgcgaaaacgatccggtcggtacagaaaccaccgccccaaactccaagttagataggcaacgaccagcgccattataatcccagtcgataatggcatatgcgcatgatagttatccgttagcaaccctaaaacaccgttaccaaattgtgaacagcaaattgcaacaattagataaataattgaaaagcccaggacggctccgcgccactgcggaaagcggaaaaaatccccactattttccaaagataaatgctcaaacgcccagcggttaagcaaatacaggccgccaccgataacaccacaaatcacccaagtggttagtaagcccccgggtttccagctcggcagctgacctaaaacatccacctgctcatatttaagcttcgttaatcctgcagcaagattgatcaagccatcatatgcaaagggcaagctacaaacgaagacaaatgtcgcaagcgcactcgcaaagatatggccaacccataacccgaacgtagcggctaataatccaaacactaacattactgccaggattccaagttcttcatacaatgtcgtaagccaatcaatccgcacctgctgtttagccaacacgcgccaagcaatcagtccaaaaacagcttccgccaacatgtatgcgctgaccaacatcccaataagtaacccgatcttacgccgataaatttgctttcgagcgaccggcaaactaaataaatattgattaaaattcgtgaaattatcgcttaagaatagtgcgactcctagcaccagactaacgatgatggcgaccaccgtttccatccgaagatgagtggcttccatcaacgcaaaactactgacattttgtgcaacataccgtgacggattatgggcaatactgtagccttcctttatgcctactagtagtaagacaccgcccgccgttaataacaacgtgcgatagtggcgccataacaactgccataactttcgtttcgtcattttatcgtccccctaagataataattcaaagtcagcttcatccgtcagattagccataaacaagtctgctaatgagagtggtaaatcttcttgaaataccgggttagttgtcgctaattgcgcctggacctcagcattataatcttcaaacactaccacgataacccgaccagaaacgtgtacaatatggcctaattgtttaacaacggctggaatctgcttgtcacgatacactaattgaacttttcgtgcacttcgtcgcatggcttctaattgatagtcattgacaatgcgaccgtgtttaagcatcaacgcgcggtcaataaccccctctaattcagccaaattatgtgacgcaatcacgattgaacggtttcccgtagccacttcatcaattagaataccaagaatgttttttcgaattaggacatccaaaccatctagcggctcatccaaaaagagatacggcgcttgcgtcgcaacactgagaatgattgtaaacaaaccaaacattcccttagagaaatggcgtaatttttgtttggacgtcagatgataacggtctaacaattgcgcaaatttggcattatcaaagtccgggtaagcagcttgataataccactggatttgcgcaatcgtcgcgcctttaaaaaaatttgccagtggatcaataaaacacagttgcgtccgcatttccggttgatcaacaacctcttgcccatcaaccaggacctgaccatgatccgtgaggtactgcccattgattgtccgaaaaagggttgttttcccaaccccgttacggccaacaacaccgacaatttgaccaagtccaatctcaaaactaatgccatctaacgtctggtgatggtcaatgcgcttacttaactgattaatcactaaactcattatttttcccccatttgatcaagccagccatgcaattcagcaatactgacgcctctttgacccgctagcctgacaatttgtgtaaactgttcccgtaattcttgtcggaacagcgttgaatccaccactttaacgtacgtgccttttcccggaaccgtctcgataatttgctgtgtctccagtcgcttataggctttactgaccgtattcggattcagcaagtgttgacgagccatttcacgcaccgacggcagttgttcaccactttgtaacacaccatgagcaatatcttgttcaataccggttactatctgagcgtaatacggttgtcggcttccatgatcaatttgcatggcccacctccatttaatacacagtcgttacttcgcttacgttaaatagtacagtatagtacagttataaacaagctaagaaaacgttaaaatcaggccacttgtacaatccaaacagtgtcctttagacctggtaggaatagtcctcagccgtcacgaaaaaagcccgtatctgccaatcgtggtaaatacgggcttctatatatacgtgctcctgctaaacaagcacgatattaggttacgatctatctgcgagtcacttacttgcgccgtaattccgttgcggcgaattccataatcgccatcaacacaatcaaactaatcggaaaagcaatgacactaactgttaaactagccgtaatttcaaagaaggtaaaaattaccattaataacaatacggctgcaatcaacatgccagtttcggcctttccccaatgcttaatcatcgtgttaacctcatttctatttattagtcatcacgagtttaacatgtctgatatcgcttactaggccttattgctaagagttccatgagaattctattggagtagccgtgtcatcgtcgtcaccgctaaccggccaccggcttttaaaggtaagaacaactggttaccatcttcaaacccgagtttctgccagaatcttgcgaccccttcatcagcagtaacgcgcgttagttggatcgccgttatattcgcttgaagtgccgcttgcatcagtccggttacaataactcggcccactgatttacgttggtaagccttattgaccatgagtaatccaacgaataaaaattgttcttgtggatactgattgagtacatctaaaacggctactaaacggtgtgctaagtaaaaaccaaaaacctgtttttgtgccgccgctagctcgtccgggtgggccgtcaaatcatgttgtacctcagtcatcgttagtggttccggtgagaaatattggtgatagcgcggattactttgttccagctttagcaatgcttcctggtcagctaaagttagtaatcggatctcaaaatccggtaattgtgcttgtaatgttgctaatttcatgatttaatcccagactttctctaaattataccaagtttcaccagcatgttcggagttcgccacaccttgattaataaaaccattacgttcataaaacggaattagtcgttccaaacaagtcaacgccatgcttgtccgcccgtctgcttgagccttctcagctagcgcggtcaataattgactaccgatctgttggtgacgtgctagtggcgaaactgccaacgtgaaaaccagctgatggccgccacgtggcaagttagtcggtgtctctacaaacatctcatcttcaatatagcgggcaccgacagctggtcccacgataaagccaagtacgactgcaccatcgcgggcgaccagaaaagtatccgctaatttctcaatgcgttcgcgataagcagcctcgctgccagcctctgcttctgaaaaaccagatttttcgatcgccatgatttgtggtaaatccagcattttaacaggtgtaatttccattgattttcgccctccaattcgtacgtatattatagcaaatgtcggtcaatagttgactaacttaattttccccgaaaaaccagtgtcgaacgtgtcgttttcagaaatgtcatgctatacttgaattgtgaattcggttacatgcattcgaattcaataattctaatcgaaattaggtgacctttatgcccgctcaatcagcagaacaattatggcatgcttataacgaaagcaccgacacaaacggggcttcttatcaaacacgttggttcggtcaacaaaataaccctgccgaagtgactgctttagccgacgcaattctggctgggacgaagacagcgacaaccacgccgctggacagttataccgcggaacaaattgccattccacaagttggcgactacaacgtcttgctaaatggtgacatgaaaccggtcgcgattctgaaaacggtggtgtctgaactcattccgttttatcgcatctcggcagaacacgcttaccatgaaggcgatggtgatcgcacaattggtgattggcgcaagcgtaagacggcagaattcaccccgacgttagaagaacacggcaaaaacctctcatcggacacaccgatggtcagtgaagtttttgaagtcgtttaccgcgcggattaatcaacaacgctaacggcctaagacggatgtcttgggcttttttattagagtgtgaggggccgcgggttgaagctgagcattgcctagccagcggattaatgcgatttttgcattgattcgttggcgtagcaagcgcaggcttcagcggcacgccacgaaaagtccgtccacaacgcacctaatttattcactaaccaaacgacagttccaacccctcaacaccactgtttctgggcgatttgaccagacaagctggcagacttaaaaaaagaagctgccaattgtaaaaaatgcttgtcaccacgtcatttttcattataattaaagctcgtactaaacttattgtttagtttaacaaaactaccgattcgaggtgaatgtcatggacattggtcaacgcatccgcaacttacggattcaaaagcaactcacgcaagaagaattaggcgaacgaactgaccttagcaaggggtacatatcacagttagagcacaatcagtcatcgccttcaatggagacgttcttcgcgattcttgaagtactcggttgtgcccccgctgatttttttgcggctgagcagcccactcacaaagtggtctaccatccagcagatcagaccacgtatgacgatgaagccttaggataccgtgtgaaatggctcgtacccgcgtctaacgaaaatcagttagaaccggtcaccgtcacactggcacctagtggtcgcttcaaatcttttgagccgtcgccggcagagacctttattatggttcaaaccggcactttaagcttacagctcggagctcagcaatatgctgccacggcgggagatacgctgtacttccatgcgactaagacgcatcagattcgtaatcttggcaccacgtcctgcacgttcaccttggttacgaccgcgtcctacttataatcatgtcacaaccaatcgagctggtattaggttacactagcttggtacacgttttaaggaggtctttactttggcggttaatacacaaccaatcattcgattgacaaatgtcactaaaagttacggggaacatcaagttttaaaaaacatcaacttagatcttgaagcgggcaaattctatacgttactcggtccgtctgggtgtggtaaaacaaccattctgcgtaccattgcggggtttacggatgccacttccggtcaagtttactttgacggtcaggtcatcaacaccctgccggccaatcagcggcaagtcaacacggtctttcaagattacgccctttttccacacatgaatgtcgcggaaaacgtggcatttggcttgaaattacacaaagttcccaaggatgaaatcgagacgcgggtccaaaaagcactcgcgatggtccaactagccgatcttggagaacgtgaaatcagtgaaatctctggtggacaacaacaacgagttgccattgcccgggcactcgttatgcagcctaaggtcctcttactcgacgaaccgttatcggctctcgatgccaaactgcgtaaggatatgcaatatgagttgcgggaccttcaacaacgcctgggcatcacttttctctttgtcacccacgatcaggaagaagccttggccatgagtgatgaaatctttgtcatgaacgctggcgagattttacaaggtgggtccccagttgatatttacgatgaaccgatcaaccatttcgtggcgaacttcatcggtgaaagtaacattattccgggtaaaatgctcaaagattttgaagtagagtttgtcggcaaacaattcgaatgcgccgatgcgggaatgcagcctaatgaagttgtcgaagtcgttcttcggcctgaagatctcgacattgtggccgcagatcaaggcaagttagtcgtcactgtcgactcccaactatttcgaggcaattatttcgaaatcgtcgcttacgataccgatcataacgaatggctcgttcattcaactaaccctgccgcagaaggcgaaccgatcggcctgacctttgacccacaagacattcacgtcatgcggttaaacgagagcgaagctgcttttgatgctcgtcttgaacaatacgaagatgattaggaggtgtcaacatgcaaccaaaacaacgattaagtcgtaacaccgcctactttatcccgtacatgttgtggatcatcctcttcgtcattgccccagtcctattgttgatctatcaatcattcttcaacattaacgggcaatttacactgggcaactaccaaacgtatttttcatcaaatacctacttaatgatgacgctcaactctgtctggtacgccttcttgatcacactcgcaacattattgatcagttatccgacggcttatttactcaacgaaacgaagcatccgcagctgtggctgctcttaatcattatgccaacatggatcaacttattacttaaggcgtacgctttcatcggcatttttagtcaagctggcatcgccaaccagtttttaagtttcatcggaatcgggcccaagcaattgctctttactaatttcagcttcatctttgtcgcggcctatattcagattccgttcatggtcctgcccatttacaactcgattagcgaactgaacccatcttacgtcaatgctagtcgggatctcggtgccacaaattggcagaccttcaatcgggtaattttcccgctgaccctccccggtgtgaaggctggcattcaagccatcttcattccctcactgtcactcttcatgttgacccgtttaattggcggcaataaggtgattacactcgggactgcgattgaggaacacttcttgacgacaatgaactggggcatgggttcgacgatcggggtcgtcctgattattgcgatggtcatcatcatgtggctcactggcagcagtaaaaagcgcgcacgaaaggggttgacgaaataatgaccttacgtaacttcaagtggcgcaacttatacctgtggcttgttttcatcgtgctgtatgcgccaattatttttctagtcgtttactccttcagccaaggtacgactatgaacaactttcatggttttacctggcaacattaccaagacttattcgcggatagccgtttaattgccatttttctcgacaccattttgattgcgctcttatcatcattattagcaactgtcattggcacgctgggggcactcggaatcaatagtacgaccaaaccgattacccgcaacactttgttatcgttgaacaatatcttgatggtttcacccgacgtcatcatcggggccagtttcttgattttctttactgcccttaaaattccgctcggttttggctcagtcttgttaagccatattgctttttcaattccaatcgtggtcttgatggtgctaccaaaaattcaagaaatgagcaccagtttactggatgccgcggctgacttaggtgccaacaattggcaattactcagccaagtcatcgtgccctacatcatgcccgggatcttttctggcttcttcatggccctgacctactcactcgatgacttcgccgtcactttcttcgtgactggaaacggctttagcacgctgtcggttgaaatctactcacgggcccgtcaaggcatcaacctggaaatcaacgccctgtccggtctaatgttcctgatggcactggtgttagtgattggctactacttcattaaccaatacagtagtcggcaccggcggccagcagttagggggcggcgaaagtgaaaaaattattaagcatcatcgttagcttactagtcgtctgtggcttactggcctttggcgcgcaacgcttgcagacgagctctggtagtactggcaaaaaggttttgaacctatatacttggggtgactacatcgaccccagcctgctcactaagtttcaaaagcagactggctatcacgttaacgtcgaaactttcgatagcaacgaagctatgtatacgaaaatcaagcaaggcggcaccagttacgatctgaccgtacctagtgattacatgattgaaaaaatgaaaaaagcgcacttactcttaccgctcgataaaagtaaactgactggaatgaagaattacgatccgcgcttcatgaacttggcctttgatcaacacaatcgttactcagtcccatatttctggggaacgcttggtatcatttataacgacaagtacgttcagccgggcagtattcaacactggaatgatttgtggcaacgaaaataccataacaaaatcatgctgattgatagcgcccgcgacgtaatggggttcgccctcgcatcaatgaatcagtccatgaacacgaccgatccagccactctactggctgcgcgaaacaagcttaaccggctatcaccaaacgtcaaggccgtcgtagcggatgaaattaaaatgtacatgatccaaaacgaagccgcaatcgcggtcgattggtccggtgaggctagtgaaatgttggctggcaattcacacttgcattacgttgtcccatccgaagggagtaacttgtggtttgataacttggtcattcctaaaacggccaaacactttaaggcgatttacgccttcttgaactttatgagtgaacccaagaacgccgcccaaaatgcggaatatatcggttacgcaacacctaatcggaaagccaaggcgctattacctaaggccattcgcaacgatcgccaattttacccagacaataacacaatcaagcatcttcaaatctatcaagatttatcaccagccaaagtcggcttgtataatgaccgttatttggaatttaagatgcatcactaatcggatcagcctacttgattcaaatgactggcatcaaagaacggtcgattataagctaaaagggcttgatttgaaacaaaggaaactctgttgatcagagacgatgaagttatatttaggattcaattcatctacgaattggatcctttttcgattctcgtcttgaatgcaatccgaattcaatcaataattttttaccggttattgataaacattttaatgttagtcattagctgaggagtggtatttcctacattacctgggcctactttaaaggattgataatcgctcttttcaaagctgtcataatcttttaacctttaggaatatataagagaaaacatctttgtcactaaactactaatagtggcaaagatgttttcctgtctagatattttgattatgaatactgcaactaaccatatctatcctatagttagatacactttctgcatatttatcatatgatacgatttatttgtattataaaccttagtcagcagcttcttgacgattactttgttcatcaagtaattgtgcaacgtttatagtgggcaaaataagtgctggaaattggtttgatgcattagttataccggatactagcgaccgaacataagggtagagaatggcaacagcatttttcttgattaaagtatcaataccaacttgattatgatcttctttctcatgatagacaaattcgccactgacgctcgccgtaactataaatggatttttcttctccgccagcgatccgatatgcacatcaactgttacaataattttgtcttgccttggcgtatttttaatttcaattttgggatttatactaatattctggttagtttccttatataaatcgttttttctataactcaactcattaactgtatagcttttaaattctaaaactgccattatgcaacacctccaacaaattcttgaactttaaagattgtggtttctgaagaatcattagttttatagaaatatttggccgtatctacatattctgtttcagttaaaaccttagttaattcggcactatcactcgtatctgaatcataagaagtcaagaatccctgtttttcgtaatcttgttgtgcttttctaaaagagacttcttgtgaaagtgtttgaactcgtttattgttctctatctgtgatacttttgcatagctaatacctaatcgttcagaaaagacgcgctgacttaagtgcaaattttctcgtaacttttttatttcatttggttgcatgaatccttttcgatttctataagcattaaaggcctttctaaaattctcattggggtcatcaaaatccaaccaaagttctcctcgagaatctttccagtaatgattatggactatcaagtcagatatgtctttgactcgcatgagttcgtatttccacacctccgaatattcctcagtggtatttaattcttcattgtaaaaagttttttttgccataatgagtacctccaagaacgtaaagtgaaaatagtctattatttaataaggatattccaacgggtattcagctggatgagttgaaatccaaaatatgatattgccgcccttaatttgaaactttagataacattcaatattttcgatgtctattccaaagagccacacatctcctgggattctggggtggtgattatccgccattggaccattaacataatcgcgccatgtaatttgttgatatatactgtctaaaattccatctaaatccatacctaacgttactgctgctgaataattctttgcgcgatgactaatttgccagttgtttcttttcaactttatcaaagcaacaatcgctttggcatcttcctcttgagacattcaaaaccaactcacaatcgaattttcacttgtaataactatatcacaatgtgtttcccacgggaaacacattgcacttttactttaattaacaacaacagccattttggtttctaattttgatagataaatcgtactttatacgacacaaaaatagtgttgatgaattttatccatcaacactaaagattatagaccccaacagagtgcttcaagtcaggtcctttaatgtttaggcgcttaccgccatgtcagaccactaatgattaaaaatttaatattcgcgagcactactagcgctagcactaatcctaaaccgagccgatttagccaataacgatccgcggtggttggaaagacgataaattgtaagtttaaaatgagtagcgcgcaaaacgcactgctggccaaccaccaaagtgtgttagaaaacaaggttatcagtaagctgcccgctaccactagggtaaaccacggttgaattggtgttcgtattgatttagtcgtcattttgaccgcccccttatcatgccttcattgtaaggggtgcccgtaaagtatcgttagtcccaacagctggttacttaattgcccgaatcagcaaccagctgagccattcgacggttaactagtccaaaatagccaccacagaaatcgaatttctgtggtggctatttatcatactactggaattaatttaatgattaatgatataagtcaaaacgccctttactgaagaccgttcctaaatgcgcactttccaaaagtgagcggtcagtaataattttcttcaatgccgatgccgcgtaaccatgaaccggtttgttactactgaagatttcaccaataccgtcacgatcgctcaatgaggccacggtcccactagattcatagtggaacgttgccgttgcttggttatgacgcaaagcgccaatattcttggcagcctgttcgccagctgccagtgcaatttgagctgtggttggatatggccgattgctttcgggatccatcactgcagcgacatccccaacaatgaatacttcgggatgcccttccagcgataagtcgggcttaactacgacccggttacggcgctgatcaaaaccggaatcagcaataacgtgtgaaccactgacaccaaccgtccaaataatcgtgttagccgtaaattcatgttcgttcttgtccgcgtcactgtaaaccacagcgcccggcttgatggcctcaataacggcacctaaccgcatttcgacattattcttttccataaacttcaaagcgtagtcccgcaattcctgcgtaaacatcggtaaaattgatggcatccgttccaaacaaactaacttagcagcaggtgtttgatacttcgcctgcaatcttggtaacgtctgggtcagttcacctaataattcgattccagtgaacccagcaccacagaccgcaatcttcaaatcatttttgtccttactggtacggtaggctttaaaccgttcttccaaatgttcataaacagcctgtgaagttgccaaatcatccattggcaaggcattttcatcggcgccagctaccccaaatgtttctgactggaagcccaatgctaatactaagtagtcataggtcatttcaggatgatcttcaaaggtcacttgtttttgttcaatatcaacgctcttgaccgttgcttgaacgaactggacccgcttaccgataatatctggaatctgataagtaattcgatcaggtgcgatcgtccccgctgcgacttcgtgtaaattagtcttctccgtatgcgtcggtgtctgatcaacaagaatgatttcatcctcagttggtagactcttctgtaaaaacttgacggctcgcatccctgcgtaacccccacctaacaccaaagttgttgccatgatttattaacccctttcattattcctgttgactaatgccgcctgtccagcaattgtgctaacctgcgttgatcacattaatccagttataacttgataactacatggtacactcttcacgcctaaaattcagctaaaacgccacgccattttaattgttcacaattaatctagtttagtgattaaacttactcaatatgctgggtgacattagccgtgactaacgacagactttcaaacaaaacttgttgttggcccggcgttaactgctcaccaaccaagtctgcacaccactgctcataagcatgcaattccgggtacaacgcttgcccagcgctcgttgggtacaaacaccggacctttttattctctggatgtgtctgcttaatcacgtaacctttttttattaagttctgaacggcgcgataattcgtggttcgatccatcttcatttggtcagccaattgactaaaaaataggccaggctgctcacaaattcgaattaaataaataaactgattgttattgaggccgtatttcgcaaaacgttgattaccctcgttcgtgacgattcgcgacaacgtgcccatcaatcttaatgttggtatcatagaagctccttttcattattgcatatgcaatcatttgatgataaacttagcactatgctaaggaggcatcaccatgtggtcgattaaaacattctcagaactaacaacaactgaattatacgctatttatgaattgcgcgtcaaaacgtttgttgttgaacaacagcgcatctatcaggaagtcgatgatactgatttaaaagcttatcatgtctttaaaaccgtcaatcaaaatattgttgcatacgcacgaatctttacagaagatgaccatctctccttcggccgggtcgtggtggacaaaaaccaacgcggacaacacttgggcgctgatttaatggcccatatcgaacaggtcgtacaggaacactatgctgatttgccaattcaaattgaagcccaagtgccagtacaaggattttaccagcatttcggcttcacttcgagcggtaccccttttctattcaaccacacgccccacatcaaaatgactaaacctgcgcgacaacgccaatagctgagcacatcacatcggcacatatgtggggacaagagttgacttagcgctatgctgattagaatccaaaactcaaaacgcgtgactcggaccacaatccgaatcacgcgtttttaattgactcatttattcagctttagataaccgttcaacgtcacgcacaatcatcaactcttcattagttgggacaaccatgaccgttaccggttcgtcatctttgctaataatttgttccttaccgtgcatatgattcttttcatcatccactgtcacgccaaagtatcctaaagctttagtgacgcgttcgcggatcatccatgagttttcacccacaccagccgtgaagacaagggcatcaattccgttcatttcagcaatatagctgccgacatacttcacaacccggttaacaaaaatatcaattgctagttttgaccgttcacgggtatcttgcgtcttatcaagatcacgcatatcaggtgacaaacctgaaataccaagtaaccctgacttatgattcaaaatatcaacaaagtcttccacatcagagatccctaaatggcgcatcaagaatggaataattgaggcatcaatatcaccggaacgggtactcatggtaatcccagctagcggcgtaaagcccattgaagtgtcgacggctttaccatgatcaaaagccgtgatcgaagcacccgaccctaaatgtaatgtcactaatttaagcgaatccaatggtttccccaatagttgggccgtccgattagcaacgtaacgatgacttgtgccatgtgccccatacttccgcgcgccaaatttctcataataatcgtaaggaatactatataggtaattaactttaggcatatccgcatacagcgaagtgtcaaacacggctacttgagtcgcttttggtaataaatcacggaatacttcaatataataagcctgcgttggattatgtagcggcgcatactcagataaatctttgatttttttcaaggtttgcgaggtaataacgacagagtctttgaaatcttcgccacccgcaacaacccgatgaccaaccccagtgatttcactaagatgagtcacaatattatcgctcttcagccgtgttaagaccattgcagcggcttcttttgcatcaattcggtccttagtttcagaatatttactaccatccgccttcttaattgtgaaaacggaatctggcaatcccagccgatcaaccattcccgatgcgattaccgtttcttcgggaacactgaaaagcttccattttaaagttgaactgccggcgttaattgctaaaatttttgccatgactatttttcctccatccatcatcaagtgtgcctaatgccagtttaactaatagtggatacgctttcaaggatttgttcacaaactttcaattttcataacattgcaaacttaattgtcggcatattatttctttcataaggcgaaattagcctataatatagttaatagaaagtgaggcgatcatgatgaaaaaaacgtttacttggtccgtcagcaacggctttgctgtcctcctcctgaccgtgggaacaattcttgctatcatcactcttggtattagctttggttcaccaatcagtgtcgacgccatggtcacagcagcggctctgtggctagccggtgtcgtcttcttacatccagcccctgtgagaattctaattcccgtcatcacattagtcagtctcagccttggttacgccacctactttagcacgtccggttcatggttgcttgcgattttagcgaccattatcacagccggcatcatcagctacggttttagtctccgcaagagtattcgccaacaccacagccattggtacgattaacttcctagtctgatccattttcttctaaatcaaaatcgtcaatctaaacatcgcaacaggcatcggcgcccttatcgcgatgcttttttatttagctttcaatccagattgttaacccgtatcagtttttcaaaggcaaaagtgaccagctaagattcgctggaaaaaattcggaatggcgtgaacctgtctggctagttcgtcctacattgactcccaggcattttcgccaattgctggaacacgacgagcccagattcaagccgccgaagcccgcgtcttaaatattggtctgccgcagcttaaccatcatttaaggccacatcacagagccccgcccggcatcatcaatcaacagcagacaaacacgaacagatgttttataataggaagcgactaaattcagaagggatgctccgatggcaactaagattggaattcgacaattggtagaattcgtcttgcgacaaggcgatttaaatgaagtaaagaatagccagaacactgcattgaacggtgctaagattcatcgtcagctccagagtagtcgtggtgaagactatgatagcgaagtttacctgaaaaaaattgtgacgatgaacgatactgattacattatcacgggtcgggcagacgggattcagttaaatgatgatggggcgttgattgaagaaatcaaaacatccgatcaagtcttcgaggacttaagtaccaacacgttgacactttactgggggcagatcaaagtctacggttacctgttactgcaagaacatcccgatcttgagcaggtcacgttgcagctgacttactttcaagtcatcaatgaaaaaatcacgaagacccagcaaatccttcaccggggtgaactagacgcattcttccacgacttaattacagaatatgaatactggttgacattacgagccgatttacgacgacaacgaaacgcttctattgaagacttgccatttccgtttccagcttttcggccgggccaacatgaattggctggcgctgtttataagacaattcggttgcaaaaacgcctctttgtcgaagcaccaactgggacggggaaaacgatctcaacgctatttccggccatcaaagcaatgggcgaagacgtgattgagcgcctcttttacctgaccgctaagcaaagtacgcgccacgttgctgaagaagcggtcacgctaatgagtcatgacggactcaaactgaaaagcattacgctaactgccaaggatcagattcggtttcccgaggaacaagatgtacttccggaagataatccttatatgattggctactacgaccgacttaaaccagcactcaaggatctgttgacccatgaagaccagattacccgttccgtgattgaacagtatgctcgcaagcatactgtcgatccgtttgaattttcactcgacacgtcgctcttctgtgatgtgattatttgtgactacaactatctttttgacccattagtctatttacaacggttctttagcgaacgtgatgacgacaactttttccttgtcgatgaagtccacaaccttgttagtcgctcccgtgatatgtactctgcggccgttagtgaccagccaatcagtgcgttgctaaaattagccaagcccgataaaagtcagccgagtgacgacttacaacgcgaactcaagaaagtccggcgtagttttacgcgcatcagtaaaaccttgattgatgaccaagtaacggaacaggtgctacctgatcccccggacaaattattacgcaccctcagaacatttaatgaatttgtgactgactggttggcgcaacaaaagccggggccactgctcgacgccgtccgtgactatttcttcgcctgtctgacctttgttaaaattggcgacctatatgatggcagctaccagacgcgcttcgtccttgacggtcatcacttaacgatcaaggaactctgcctagatcccagtgactttcttaatcggtcattagagctcggcagtggtgctgtcctattttctgcgacgctgaccccgatggcttactaccagcgggtgcttggcggtgaagccaacagtttggcctaccagcttccatcaccatttccaccaaagcatcaggccattctcgtcacccagtacgtccagacaacgtatcacgaacgcgaacataacgtgccccggattattgccagcttgcacgccatgttgacggctaaacatggcaactacctcgtgttctttccgtcgtatggctatctgttgcagatcaaaactgcctttgaagccgcctaccctgatgtggcaactaccgcccaagcctcgacgatggatgcaactgcccggcagacctttttgaaccagtttcagtcagcaccctcgcaaaccttactcggtttctgcgtactgggtggtatcttctccgaaggcattgacttacgtggcgaccgtttgattggagtcgctatcgtcagtgtcggtctgccgggtatcaaccctgaaacgaacttgattcgtgactactacgaccatcaaaacggcttaggattcgcctacgcttaccaactgccaggcatgaacaacgtcttacaggctgctggccgcctgatccgcagtgccaaggacaccggaatcgttctcttgttagaccaacgcttcgctagtcggcgctacacagatttatttccagcacattggcagtactatcagacgatccaatcagtcccgcagctcgaagcaacgattgccaacttttggcaccaaatggaggtgactcattaatgaagactaaattaactaaacaacttgaaagtactctctatcagtactgtctagaacagggcgcctacgtggttgaagaagttgcgatgcccgctgataaagggatcgttgatacattaagctatcaacaactccccgatggtcagattgaatggcgttgctacgaattgaaagtcaccaaagcagattttcattcaaaggccaaactttcatttatcggtcattacaattactttgtcttgccgcaacaactttacctagaagttcaatcggaaattccagaccatattggtgtattgatctaccgcgcttttgatcagcgggccctagagctcgcaccccaaccgttgcgaacgcctggtttcctaactgtcgctaagaaagcccaacgccaagacttacaagtcgagcaaacgccccttatcagtcacttcatcacgtcgctctttcgtgaggtcgataaagccaagcgtgtgaagaaaggactacagctctactctgatgaccaactcttcaaagaattacgcaaacgggcccgcaccggctacgacgtttatgatcctgaacaaaacttgtacgatcgcttcatcgatgacacccagaatgacgcggtgactgcgctacaaacagaattagatgcccgcaatgccgaatatcaggcactcaaactaaaatatcaggcgctaacggcaccagatttgcgtgaccagttatgagcacttactacccctatctacgtggacggatgtatgatttgttagccttaaaaacattgtgcgagcaacaccaacttggcccacacatcatcccagtaattgaaccagtccgtgactccaaagaattacaacaaacagtcacgacttttattgaagcccaacaaccatttagcattattgcgaatccccaagtgagtgtctatggtcttaataccgttaagctccatccacttccggatctgcgtccctacccattttaccggccgggcgcaattcttgcggccgattttagtcgcgactttctgacaaccagtcctggtcaaacaagcttgctcatcgcgcctaactatccgttgcttaaggcctatcagcatacgaccactttacagcatgctggtcatgtcctaatccctgatgaagcgcgtttgcaccaactattaccacaacacgcggtcttattgactgatcccgtggcaaccccagcgcacgttgcggactatcaagaaataactgacgcctattttgcccccgctaactggcaccaaacaccggttggctttgatggttttggcgattactcactcatgggccgaccctattttgaccacggtatgccatcacgcgcaattgcattacatcttatttatgttacggttaacggtgacctgcgcatccatcattttgtttcggacagcaatgccaatatgcgtggtcaaaagcaaaagttttttgaagcattaacaaagctcaccgactgggcacccgcacacctgacgggactcaatcgcacccccgcgcttgccaccctattagcctacgctgagggcgataaattcccagggttaggaataattaagaaattagcaatcatgcaccactttcaattgatgcaccgactactagcactgaattgaggagaaatgatggcaaaacaagaatctgcttggaaacaaatgatccatttctatcgtcatgattacgaagaacagcatgctccgatgttatacggcgacgtttggctgaagaccaaatcacatgaccggcttctactggggttaagtgaccaaggacaacacaatctgggtgtcgttcatcaactcgatttaccaactaagggccagcacctcgtggcaggtgatccgctcgtcacgattacggacgatcaaggggcgcatctggtgtcaacaccctttagtggcaccgttcagaagcttaacaaagacctacaagcggcaccccaatcgctcattaacaataaacaaaccgacaactggctggtccaattaaaggccgactaatttcgagttaccaaaagtaagttggctgacattcaaacaaacgcttacatttccactaaaagaactcgtaaattggcttaactaagcttagtcacgacatcagcggttgccagtcccagtgatatcacgcttcgaactttaatcacaacatttggttatgttaaccaacagacaccgtcttcatttgtaaacagccttgattgacccgctcagaaacaattgcgccgcgcgttatattacaaaagattacaaaacacgccgtttattacaagaattagggtaattcgtaaaactcctgctatttccctgtcacaatcgccagttatactaggtaccattgagtgcttggaagattcgcggggccaagccaaattcggacaaaaaataggagtgtacattacaaatgaagattaagaatgctttattatcaactgctgccgctactgctagtctctttgccattggtgctaccgctcaagctgctacggtaactgttaaagccggtgacacggtttctgccattgctgctgatcataacacgacgattgatgcgatccaacaagctaaccacttaaaagacgttaacttgatcttagttggtcaacaacttgaagtaaatggtgatagcactaccacgacttcaacacagacgactcaacaaacgactacgacacaatcatcagctcagactagtcaaactcaagctcaaccgagccaagctagccagacccaatcaagtcaaacacaaactagcaaacctgctgctcagacgacgactcaaacgtctagttcaacatcaaactatagcaacaatggttctgatagtgctgctaaggcttggattgctggtaaagaatctggtggttcatattctgctcgtaacggtcaatacatcggtaagtaccaattaagtgcttcatacttaaacggtgactactccgctgccaaccaagaacgtgttgctaacagttatgttgcttcacgttatggctcatggagcaacgccaagagtcactggcttgctaatggctggtactaaaaagccactctaaattaataaacaaatgcaaagattgcggatcatttctgattcgcaatctttttttctactattaaatccgtgctgaagcacgtgtgtcccccaccaacacccattataaagttactcagttgctaagtgactttataatgggccttagagcatgctgacaacccgttatttagatatgcgatatgcttattctggcaaccgctttaatacggacacgatccagacctgctagttgtccccccccaatcgacgacccactctcccaaccaaaataccacatgtttttatttaacaattcaccaaccttaacggagaaaatccaactaatttcctgactaagtacagtcccgaacctccgacagtttgacgactagtccacaacgacaaccacataccattcagctatggcgtaatactaacccagtaacgttttagtagcgatcgtcatgggctacttttggcataaacctactatagtaatacttaattaatcgacgccttcgttaaccaaccacaattgactacacgatgcgcaacttctatcaattatctgctttatcgaaaaataattagtcagtgccacgtctccaagcaataaaatgactagttaagtgtcactataatcagacttcccgacaaattaacccgtcaaaattcactagttaagtgcttaaaattatcgataatcctcgttgacttttcataaatcgaccaaaagtgatcacttttatcggataaagcggctaattttcatcattagtttccccgcttaatcattgtcgttattgattttctagctagttaatcgggattggtagcgctattttacatgaaatccggctcaaatattacaattcattacaaaaacggccttatattacaagcaccccctaaaaacgtaatgttctgattattgcactgcaacactcactagttatactagtcactgttgattggttgagacatcaactgctcgaccaatagaaaatatatgtaaataatcgaacacacgcaaattataggagagtgtattaattattatgaagatcaaaaaccttgtattatcatcaactgctgcattagctttattcgctatctcaacaacggttgccaacgctgatacttatactgttaaggccggcgatactgtttcagcaattgcccaagctcacaacacttcagtttcagccattgaaaaggcaaacaagttagctaatgttaacttaatcttcattggtgataagcttgaagtcaatggtactactacaacaaccacgacttctgctgctacaagtgctgcaccacaatcagcaactagccaagctacttcttcagctgcttcaactgcaacgagtgccagtgctactagtgcttcttcacaatcagttgctagccaagctactagttctgctgctacttcttcagctgctagccaagctacttcaagtgttgcaacgagtgctgcttcttcagcaagctcaacgcaatcagctgctagccaagcttcaagttctgctgcaaccactagtcaagcttcatcaagtgctactagctcagctgcatcatcaacagcttcaacaacctcaacgacttcaagctacactggtagtaacttaaagagctacgtattaagccaaatgcaatcacggactggcgtttcagcttcaacttggaacacgatcatcacgcgtgaatcaaactggaactcaacggtcaagaacagtacttctggtgcctatggtttattccaaaacatgcacatcagcagtggctctgttgaagaccaagttaacgctgccgttagcttatacaacgcacaaggcatggctgcttgggctttataaaataactgattactaacgaacagcgtaatgacattaattgtcgttacgctgtttttttatgctcagattcatttaaaaggcgtatgcttagtagcgagaatacgaggaaggatctgaggagatgcgccacgaaaccaaattagtcatcacactatggggtggcatgttaggcagtatgttgttgattggcctgattttccagctaccacgcttaacccaactcccatcctcattaacaactggggtcgaagagctgttctttttagcaattgcactcatattaaatcgtgactggctacggcaaaccttaaaattcggggtatcggcaacttggcgtcggcaaatccggcccgtcattccaaccttaatcgtggccgcactaattggcctatatacgttagcaaccgcccaacaactaacaaacaccctgaccctgttattcgttgccatattgatcagcctcttcgaagagacattttttcgcggaatgctatttcaggcctgccagtcaacattgggtgtggtgaaagccgccatcttcactagcatcctcttcagtttgacccatctgatcaatctcggtcaccaaacacttggtttaaccttattgcaattgggctttaccttcgtactagggctacttttatgtctaatcacggcgcagactacatcgctactatggccattgttgattcacgccgtcaatgacttctttagcatgatggcacctccaatcaatctgcccggtataacgacgactagttttcaaatcatcgaaatcgcggtcattatcctattaattctgccgattctacgccaaaatcaccagtggctgtcgtaatgaccaccggcaactaatcgatccgtaattaatataaccaacaccttcaatgtgacctatactaaagttagcattaacttctggaggggatttcgatgtcatcaaccaaacgcggctggggagccgctattagtattttcattttagtaccaattctttttaaattaattgcctggctaccagtaccaactttatacagtgggctggtccaagacttgcttgtattacttattttcctgctattaaatcatttttggtttaaaatatcgattcagtggtggcaatcgcaatcactcgtacgacaatgcttgcagctcatcccgggaattattattttattactaccaatgacgagcaacttcatcaagctatgtcatcttgcttggaccccaacgttaattctctatattggctacgccctagttatcgggatcactgaggaatatatctatcggggcatgctcctgccactactacgacaatgcttccctcaccgactcatgctagccatttgtatcgacagtttactatttggtcttacccacctactcattaacagcagccagctgaccctcagctatgtcatcccacaagtcttttatgctgcagcgggtggcctgattttttgcggcctttatctacgaaccaataacttagtctggccgattttcttgcacgccttatcggacgtatccgtcgtcgttagtttggccacgcatacccacaccgcggccaagttgagtattccggttgcttacgcgattggcatctcggtgctctatctcgtcttgtttatcatcatcgcctttatcgttcgctggcaagttcgccctcaaaaacgattgttgtctcgttagcaattcacagtcattaaaaaatgagtccccagaatcaaatcattctgagaactcatttttagtgacttatcttgacaaaaatgcaattgtacgcgtcaactcacgtctgattcaatcgtaagatcaccctaggtttccgccacaaatttgtgcttttctaatcggtaggagtggtcacaaacgtccgcaacatccggttcatgcgtgacaataatgacgcacttcttttgttcatgcgcaattttttgaaattggtcaatcacatatttcgtattttcttcatccaaattaccggttggttcatccgcaaccactagtttagcatcgcacaccatggtccgtgcaatcgccacccgttgctgctgaccaccagataagcgttgaacattcttcttcatctgatcatctgtaatacctaaccgtcgtaacatcttcatcgcataatccttgtcaccacggtgttccgagtttgtaattgccatggcagtcatcagattattcaatggtgacatatacgtcaacaaattatatgattgaaaaacgattgccactttggacttccgatagttcgtcagaccaatcttattgattggttcaccattgagttcaatttgcccagcccgcggtttatctagacccgccagcagtgagaggaaggtcgtcttaccggaaccactttgaccaacaatggcatacgaagtccccgacttaaattcaaggtttacattctcaaatagactattttcttggcggtcataccagtaaccaagatcatttacttttaacattgccgcccctcctaatcaattaaaactttcttcggctgtagtcgtagtatgccaccagaagccagcataatcgacaggaacatgatggctaagccaaagccgccgagttcaactaaatccattaccgtgacattaatatctaagttcgtgtcggtcgtggcactggcattaccagtctgaccgccgccactaggcatattgccgcttggcttgctaccaccagtgttaccactaggggcgccgccaccgccaccaggctgaccctgctgactagttgaactcgtcgtagtcgttgcagttgtcgtttgttgtgaaactaactggtcacccagcttattaccaacaaacttaccaccgaatccggctaagacaactgagacgatcaagaccatcaccatttcagcaaagaattgagcgacaatcttccaacggctctcacctaatgataacaagacaccaatttcatagcggcgttcacgaatcatcaagataacgattaaagctaagataatcgttccagcaatcgcaacgagccagacaatcttatccgcaaatgatttaacgttattcatcgaactcttaaccgtttggtaactgctatcatccgttgacaacgaatacttcgacgtattgatcaactgtttaccagacgttttgacgctgctaactttagcggggtctgagattgcaaaagtcacagaatcagctgtgttcttgtacttagaacccttgaccgtgttagcgaacgtgtatgacgtgtaaacactgttgctgacatcggtactatcaagaccttgttgcgtacttgcactagatgacgctttatagatcccaacgatcttcatcgtgtaagtcttcttatcaccggtcgttgcttttaacttaatcgtatcaccgacgctcaggctatcttccttagccaattcactttcgatgacaacgttgttagtgccttcatcactagctgtaataccgcggcccttcgtaattttacttgagctactttcaaaggttgagacgctgttcgtattagtgaccccagtaatcgagatatcaccagtaccactgctacttgagccacccatacctttcatcccaccaccggtactactacctgatgttgaaatcgtatcaaagcccttcgcattagcggaagttgagacggtcgcattgtaacttgaaacgttgctaagcttggcgattttcttcgcatcactcagtttaacgggcgatgtcgtcaacttaggccgactacttttactcgtcgacgtggcgctgcgcatcttcttaaaagccgcctcccggttagcagataaagtgacggtcgccccgacacttttcttggcattactagttgccgtatcggcagcattcctaatcaataacccggccaatacaaacagcatgattgctgatgtaacaagcactaatagaattgaacggcctttttttgccgttagattgagccatgcgcgtttaaaaaaattcacgcttaaaccctccttcagataaagtattggtatgacaattgctttgcactgcttttaacctacacgggaaatctgactaatttgtgaacttgctgggtttatttatgggtctgaaaccgaagatttttcaatttgctagctaagcccctgaaaggctggttgtgcttgctactactagcattgcaccgtatcggaggcccgtttaaatgcgttagtcagcactttcgctgaacaccaaatagtcgcgacaagaattagcaattaattcttgtcgcgactattgaacttattgattaaacgaattacttacacaatcgtaaactcactcttccggtacggtacttaagtgccacgtgatcgtaccctgataacttccaggaacagcggcgggcgttgttttgagcaccaaaccttgttgcgatgaccagtgggcggtcacgtcatagtcgatccccggggccgtcttttggcgcgcgatttccacggcatcctttcccaacattgtcagcttggcaccatcctgataatacaagtttcccgctagtgtgcggccctgattagtcacgagaggggtcgcggtcgcctctaagcgccaagcggctttcgagcccgtatcatcattgacaactacttcaagtccctcgggccgactgacttgagccgttcccgtcaacttgattggtgcaaacacactttcagtactgacttttttcagctgtaactccccaccaatgaccgtgaccgttactgtcactggttctgagtaggcgttatctttgctatgagcccgtaacgtaatctgattttcaccgatttgtagttcttcggcatccacttcaaattcgacataaccaaccggatcgtccatgctcaactgatagtcttctcccgcttcaccattgacccggtactcgatacgcatgccatcattgtcaaagtctaacccatcatttagcttaatttggcccttaatgatgacgggctcgcctttcttcacttgtgtcaacggttcaatcgtcaggttaacggtcttattggtcgtaatggtgaagtgcggtgtggccgttgcggtcttcatctcgtgaccctcaaagtaactcatgtcatcatcaacaaaagtatcccgatcgaccttggcagcctcaccaatcagcgtaatataagcgtgcggatttttcattgatagtgtccgctgcaaatcgtgttgtaagcgggccaccgacgattcgttatcgtccgctggtaaattgatctcttcctcggtaccatccgcatagcggatcttcgcgtgactaaagtgaacttgttcgggtaatggtaggctggccttaacctgttgccattcattgtcaccattgagatagctcagaacgtactcatattccaactcatccccaccatgaacccagtctccttcatggacagttcgctcttgagtcagattggttacgtttaaatctgactcgatttcaatcggttgtggcaaccggtcaaagacgaccagtgttctggcattagcggttgtcgccgtactagttaatccccaagtaacattccggatatcctttccaaagactgttgtatcaattgtggtcattcgtgttggtccctgatccagggtataactcatgatttgtttactggcgacccacttcaatacaagatggtgccagttaccgtccgcgagtggtaatttatcagcgatactcccatggttctgttcaaaacgataagaggacgttaaaccaccccgttgcgtataagtatccggacttgaagggtaactggcggccatatgcatttttttaggcttttcatcgaaagagttcccccggggatataatccccaaaaaccaccgtcattcactttggtatccagttccaacgcccaacttttttgaatcgccgtcttagcaatcgtggccggcgccgttcgccgtgtataggtatccgtcccataaacacccaagttctcaccaataatgcttttctttccataccgactaatcgcactcattttgcggggatcattctgtaaaacaacggccagtccttcactcacggctttgtccccaaagttcacccacattgagacttggttatcgacccgcatgttaaagcgattaacaggggtcgaccacattgccccaacttgattatcgtcatttgttaattcgataacatgctgcgaatggccattctttaaaacagtctgcattgtggccgaattacggtcaaactttcccggttcaaataagccttccagattcagtccagcgggtgccgtatcaagtacgtcagccttactaactaacggtatcactgcccctaaacagacaaacagtcctaacaagagtccccaaaaccttacttctttcacctaacgtcgctcccatcacttgccttccgcagctattcttacgccgtatcttagcaaattaagcgacgtcatgtcaattatttttatgtttataataagtatttatttatacataaaatttaagcaatcgcacttataccaaaatatattgattttaataaaaaccagcgcctgacagttgtcatcgcgctggttttaaattgacggctcacttactcaccgcgccaggaattaagcgcgttaggccggtaaattttctggagcaaatgggcagtccaccacatgatcattaatgagaccagtcgcttgaagataagaataaatggttgtcggtccgataaacttgaagccgcggcgtttcatctctttagacacttgttgcgccaagtcgtttgttgctggaacctcatcgattgacgcccacgcctggcgtatgggctggttatcaacaaacgcccataaccaagtggcaaagtcttccccggccggccaatctcgaatcacacgagcattgttgatcgttgccattaacttctgacgatgccgaataattcgagcatcggttagtagtcgctcaacatcggcggtcgtcatagcggccacctggtcaacatcgtaatccgcaaaatcttcattaaaagccgcccgcttattcaggacggtctgccagctcagtcctgcttgataagtctccaagcacaacagttcaaaaagtcgttgctgattatgttgcggccgcccccattcgttgtcatgatacgcttgcattgctggtgatgaatccgcccatgcacatcgttgcattaaaaccatctccttattgctgctattcaacccggctatctcatactcgccgcatactcccagactaaaactaacactggttttaaaatctaagtgcagccccttaaaaaagcgccgtccaacttgaatcgttagacggcgccagttggttacacttattatcgcataactgacttattttattgacgatttcgtttcgtctgcttttcagcagtggtttcgtcttccatacgatccgtcaacggataagttaagcgaatcaaacttggaataatcgttgggatggcgaataccaggataatcaacccgataatcacaaccatcgccacttgaatcaacgtcaagacaccggatggcatcaaggcggcgaacgtcccactcaagatcaaggcagcggataagaccacggccccaatgacggcggaagctctgacaattcgagtacttggtgtcgcagccgaattatcaaattcacgatacttcatcatcaagaagatactgtagtcgaccccaagcgcaatcaacatgatgaacccgaagaacggtgtgttccaagttaacatgctttgacccaagaaccagttgctcaagatccgtgtaatactcaaggacataatgtaagccaataacaaagtccctaagatgtagaacggttgtaagacagaacgcgtgataaccatcaaggcaatcaggattccgactaacataattgcagcggtccgaacgaagtcactagaagcaattgcttgggtatcgttcgtttcagacgtttgaccaccaatcgcaatggtggcaccatctaacgcagttcccttcaagctgttcgttgcttgcttttgaattgccgttactttatccatcgctgacttcgaacttggattttcattcaagacgattgttaacttcgttgcgtggttgttaccagacatgtaagccttcaaagcagacttgtaagtcttacccttcaaagtgctctttggcacgtaatacgtcttcgcagccgcggaatcctttaagccagtcaagtagctgttagctgagccaacaccagtgttgatcgtcttagttccgtcgctggcagtcttcaaaccatcttggagcgtctgcatctgacctactaagctttggatactggtgtacatttgttcattaccagaggccacttgcgaggcaccactgttaagcttgttgacaccacttaccaaggttggtacttgcgagttcaaacttgcagtcccactggctaattgtgaagcaccactatttaacgttgaagagttggcagctaattggttagtcccagaatcaagcgcactgatggcactcgttagcgttggaatttgcccttgtaagcttgtcaaaccagttgacacttgtgatgcaccgctattgactttagttgcaccagtcgcagctgttgagacgccatcggtatacgtatttaattgtgatgctaaggaacttgccccactttgaagctggttcaagccagtagtaatttgttgagagccatctaccaatccattggtaccgtttaagccagattgaatctgttgcatcccactaatcgcagattgcagctttgagataacttccaaagaaccattattagcctccgttgattttttagctaattgttgcaagttagatagctgcttcaattcactactcaatgtcgagagtgtatccaactccttagttaaggtttcacctgtcttactcattgctgctagatctgtttgcaactgctgtgcgcttgtctgggttgagctaatacttgacgacatcgaagaacttgcgctctcaaccttttgactaatttgtttgccggcagcagttaacgcagcagttaatgcagcagtttgctgtgttgttaatgccgtcccaccgttcttattgactgcatcaactattgtttgaatatcactatcacttaagctaacggagcttactccagatgcagaattttgcaattcacccagagctgtttttaaattagctgcatcgttttgaacagcattactgttgtccgccagagtcgaagcagttgttgtcattccactaatatctggtagcgaagtcgagctagtagacagcaacggtttcattgcctcatttaattgctctaaacctttttgtaaatcatttaatttttgtgtattagcagtacttgtcgcatctgagacactagagttaacactggtctgcattttttgaagaccggctgttaacgcagatgcaccagtttgcagttgtgaaactccagaagttaaagttccagttccactagagatctttgttttatacccattcagggtatctaacccagaactcaaagtattcgtcccactaaacagactattggcacctgtagacaactgattaacgccactagccaacgttccagtcttactgttcaactggttcaaaccattattgaccgtgtagacaccattagtataagtaactaatccactcgctaacgagctcgaaccacttgccaactgactagccccacttgaaagggttccagtcttaccatttaaagtattgagtcctgatgaaacttcatccgccccatccgccaactttttggccgacttcgcgctatccgacatattggcactcttcaatttactattggcgctatctaacccactaccaatcttagttagccctttgctagcagacttcattccactagtgacggtgcctaattggttgccaacgtataattgatcgatttgtgagccaccgggttgggtgacagacgccacggttttaacacccttaactttttgtaactgtttcgttaagctgtcgatgacttttagatctttttcattgtttaaggcatgatccgtcttaatatataacgttgacggttcagccgtccctttggagaagtgatcctgaacaacttggaagcccttcttcgctggaatcgtgtcgtttaattcagccaacgtatcatagttcaactcattgttatacgttaagataaatggcaatgaaacccctaaaacaacgaccagggcgatgattgggtaacgaactgatgacgctgcaatgccgtgccacatcttgctcgtactaccaccagcaaacttcttcgttggccagaataaccgtggtcctaataacgccatgaagaatgggttcaacgttaacaagacgagcaataggatagcaaccgcaatggcaaccccaaccgctgacttgtaaattgagaagttcgctaacccgagggcactaaacccaatcaatagtgacgatccactgtataggatcgttcgtccggcaatctttaacgcgcgcccagtcgcggcgaccggactatcgccatgactgagttcttctttgaattgatcgaacagtagaatattgtagtcggtcccaatcccgaacaagaccacgaccataaagacttgggtaaagttcgacaatggaaagttaaatttattaacgaggttcatcacaacgctcagcgagataatgaacgacaccccaactgacaacagtgaaactaacggcgtaatcggcgagcggaagactaacgttaacacgatgaaaatgaaaataacggtaataatttcagtcttctgaatcccagcttccgtttcctgagtgaagtcatcatttaagatgtcactccctgtcacgtacgtcttaaccccagccgttttggcaccagccgtaatattcttggtcatgttcgcgacggtctggttcttaccaaccattaattgtagtaattgggtggatttgtcttttgaaatcaattgctttttggcagcagcattatcactggcagccgtcattgatttcacgtgatattttgatttctgcactttgaagcgttgaatcgtcccatcgattgcttgcttctggtcactcgttaacggtgaatcaccattattgaagaccaccaccacttggcgcgtattattttgattacgcccccaatgattctgaatgacttgtgcgacttgactcttggcactacttggcaacttggtctggcccttatcacgtaccagactgctgatatttggcaggaagatgatggccgctaccatcacaactagccaaacaatcgcttggattgtaaaacgtctacggctccctttcacgttatatcccttccctaattcagattcttaaaacgacatcgtgacatttaatcaacaatgtgtttaaataataacaacatgttaaatgaaaaccggtgtaatttcaaccaacaattttcataaaatcgtcattaaataaacaaacaatagtatattgttcaaataatgaggtgaacttcagtggtaggtactaaaaacaaccgtcgttcgcaaatgaccgaacgcctaattcaagatagtctaatcaacttactccaacatcagtcgctagatgagattacggtcactgctgtctgcaaggccgcagatatcaaccggggcaccttttacgcccattatgaagacgtcaaagattgcatgcagaagatggaacaagatgccacggaagaactgctagctgttattgataaacatcttaatcccgactctttacaagccattctgacgggaatttttgaggtggttaagaaacgccacgccgttacttccttcatcttaacaaccgaccaggattttctgatgagctttatcgcaacgactaagcgtgagatcttagcacataaccaagctgagatcactggtattggcaatcgcgaaaaagagtacatgtttgagtattatctcaatggtatcgttggtgttgtccgttattggttaaaaacaggactacatgaatcaccggaagaactggccagttttatcaacgactggtggtaccgaggaaaaccagtcaaaaatttggctgaacactgaatttaaccccactattcgattgttagtttaattaatctagctattcccattaaattaattattatcaatatgccttggaaattatcttgcctattaaaagtaacatgaaccctttaattgcaaaagcaatctaacttcttaattactttcttctataataagataccagtcatgtgcatgggtggacttgattcgcatcaagaaaaccccaaaatgcccgattattagcaattacctgctaataatcgggcattttttagacttcttttgggggcgtcttaggttcatacatccgttgcttgatatcgtccatttcctgatccagctccgtaattaactgcgccttcttagtcaatgacgctcgcaatgcgtcctgatgcggaacgttcttcttataatttaattcatgctccaacgacgcccaaaagttcatggcaatcgtccgtacttgtagttcgacctcaatgatgctcggcccatcaacagtgtagaccggcaccccgaggattaaatgcaaactctgatagccattagctttaggatgatgaatataatccttcactcgtaatactttaatgtcagcctgagtcgccaataaattctcgactgtcttgacatcgcttaggaaacgaacaatcaaccggatacccgcaatatcatgcaaattattaaacaccgcatttaacgttaacggtaaatgcttacgttgcatcttaccaacaatgctctcaggcgacttgatccgggactgcttgctatcaattaacgcgtagccgtaacgaagctcatactctcgactaatataatctaacttatctaaaacgagcttcatcgcaacttcataacgtaacgaataagctttcaactgatcaacagcttgcaaaagttccgggggtgctggcaaaagctgatcattatctgcacttgcttgggaatttgttgtgctcaatcaatatcgctccaatataagactctattctctctcaatctaccttaacggatcgtgatggtccactcacgcgcaatttggtcatacgcaatttggtgcgcatcttcaccaacttggtaagctaagtgtccgtcaacatctgcaaaatcactaggaatcaggccgcggccctctaacacgttcaggtgaccaacgaccatgcgatcggccaagaaattctcaaatcgctgccagaaactttgaaaactggcgaagtcatgcacatcaaaaatctcgttgcggagtacttcggcatcaaattcaattcggattcgcgcactcttaggtatcacttggggcctccttcgcatcggttaatccacactgcacattcttagtgactcattaaccaacaactcatttttgggactatctcaataataagacacgatgaccaagttacgcaatatctgaccaacaactgctatcaaaacttaagcgctttgtaatcgttgggttaattgattttacgtttcgggttcaaaatattcatcgggtcaaagagtgctttgatctgatgttgcaacatatcaacatcttcgcctaattcggcattgttccattgatttttcaacattccgactgcgtgttcacccgaaatcgtcccaccaagtgccagcgtcttcttaaacatttcttgtagcgcaataataattttttcaggcacttcggttaccgacgttggccacactaaggtcgggtgcacattgccatcgccagcatgtccagccgtatagatttcgacgtctaaccgcttggatagttcttgaatatagtccattaatggggctaattgcgataatggcacggccatatcttccataatatgattctgaccagcaaaaactgccggcagcatgtcgcgccgtaattgttctagcgctgcctgttccttaggctcggtcgtaatcttaacatcgttggcttgctgttcggccagtatcttcttaacgactgccatactatcctgaccaccattatcaagcttaaagatcaacatcgccgcactattcttagcatagtgcgtcttctcgtaacgatcgagtgccgcaaccgtattgccatccaatgcctctagcatcgttggataaacaccggagattcgaatcgccgtgactgctttagccaaggccgtcatattatcgaaaaaggcgacgcccatcacgggggtccctagcggaatcggcaacagtttaacgattacttcggtaatgattcctaacgtgccttccgaaccaatcatcaattgcgttaaatcataaccaaaggcctgctttagcgtccgaccgcctaacttaacttcgcgaccatcggctaaaacgaccttaacgcctaagacattgtccttagtagccccatacttgaccgtactcatcccgccagcgtttgtcgccacattaccgccaatcccagagatgggcttagaaccagggtccggcgcgtagaacataccctgcttgcgtgcttctttatccagatcaccgttaacgacgccgggttcaaccacggcgatggaatcagccttgctaatttcgatgattcggttcatcttggcggttgaaagaatcagactgtccgttaacccgtccgcaccgataacagtgctcgttgtttggtcttggggaatcactgcgatgtggtatttacgggccgttttcaacgttccttgaatgtccttggtcgtatgtgcttcaacataggctaaggcaaggccactatcgtcatcggtcaaccgcggactgaaagagtattttttcagcgtctcctcgtcagtgaagacctgcccgtcagtgacttgcgttgctaaataatctaaaacttcttggttagaaaatgcgcgaaagactgtcaaattaccaaacctcacttcatatatttaagttcactgtcagtataagccaagaatccgttttctgccgtaatactgtccgtaagtgaccgctcctaatttgctcagtttccaatctaattcttttaggtggtatctattttttaaattaagtacactcaaaataagtattttccgggatcgtactgaccgggtatgctagaaacagtgatttcaagacaaagacgttatccggggaaccatcttaacgcctttaattaaggggggatttgaacatgcggcattcagcatcttcaaaattacggccagtgttaattgcggtcggcatcattatcgttatcgcattcgtagcgattggcttaattattcgccaggcacaggcgcgctaccaatcgacgatctatacgggaaacagcagtactaaaatcgatacgactaagccactcagcatcttactactaggtgttgacaccggggcagacggtcgtattgataagggaaattctgacaccattatggtcgttacgatcaatccgcagaccaagaaaacgctcattaccagcattccacgcgattcattagcagaaatggtcggtgatcaggacacaaatgttcaaaaactcaacgccgcttacaatattggtggctccaagatggccaaggctagtgttagcaagctattcaacgtgcctatcgattactatgcaactatcaatatgggcggtctcaaacaaatcgtggatgccgttggaggcgtgacgatcactagtccactcaacgtttcattcgaccacatcacagtaaccaagggcaaacaccatctcaatggtaaacaggcgctatcttatacacggatgcgttatcaggacccccggggcgactacggccgtcaattacggcaacaacaagtcatgcgggcggttctcgccaaactcgccgagactaagacctatagtcgctacaatcaattactcacttcactgaagggtaatttacaaactgaccttagctttaacgaccttgttgggttagcgacgcatgatcgtgccaatatgaaacacatccagtcgactcaagtcattggctcacccgcttggatcaatacgagttcctatcagattttaagtacaaagaccttgcaacaaacgtcggaccgccttcggacccaactggggctcagtactgagacccttaccaacatggaaaccaagctaaatgccaagaataccgtgtatgacggcaaaaccaatctcaattatgacacccaaggtttagataaaatcacttacagtgataataccaagtgatcttttaatgataatcaggcgtgccactgaagcagtatagccttcagtggcgcgcctgatttagtcctaacctagttaaaattgattgctgccattagtattattggttgttgattgcctaaagtatcacagttactgcttgtctgtcaccgtcttagtgcacccagccagcaagttgcgtcaccagtcccccggtatcgtcgttaaactcatatttgatattcccccggtcagcaacggcctggtgcttgttcacctgtaaatcactcacccgaaccgttaattctaaaggcttaaagttttgaactgagcgaatccagacatagtcggccagtcgttgtacttgcacgaagaaataccgttccgttgtcgttgttaaatcaatctgttttaaaattcccgtttccattcgtgctgcaccccctcgttattttcaccacttaatatacgtgctgaaacgcgttccaggtcaaggcgcaacactcaattatttttaattgcaagtttgaatattacattttaataacagtaagcgaaaaagctagtcaatttagtcaaacggttgtactatgattgatgataaggttatttaagtcaacgataactcgttaaaaccatccaaaggagcaatctcatcatgagccagcccaacaccctgcatccgcaagcgtattgctactacatcgaactgactggttccgaacggcctgatttactcaccgcactaactactagtgaacaagaattgggcgattgggaaccggttcaagcagctaagttaccaacttggcgtttatggactgacgctaatgccgacacgattcgctacaccgttgcacacgtcattgcccgtagcgctttgccgcaaaacgcttattggctattgcagtacaagggtactgaccatggtcacccccgaatgttgcacccacaatttcatacccgttaataaaaggcgaacccggtgacaattccaagtcactcggttcgctttaatctgcacgcgcttctcaaaaatcgacattaaaataccaccatcaacagactttcagcaagtcgctaatggtggtatttatacgattactacattaatgatttaacttaagcttcgaccgtttcgccagcagcttctttagcagcaaaggtcttttcttccttaaccttatcacgatctaaggccttgaagaagaagtagtagatggcaccatcaagcacaatattaacaatttgtaataccgcacctgagatgtgcatcgttgctaagtaaccagagataattggcggcgtcgtccaaggaaccatgaccccaaccgtctttgcaactaagcccgtcgacattgcaatgtaagtcgtcgtaacattaactaacggtgccaagataaacggaacggcaatccgatagttcataacgattggcaacccgaagacaattggttcattgatattgaacaatgcgggtccgataaccagcttgcctaatgtcttgaattcggcactcttggcaacaaaggcaatcatgaaagccagtcccaaggtcgcaccggaaccacccatgtggacaaagttgtcgaagaattgttgtgtcacaacgtttggtaaagccttaccagccttaagcgcttccgcattttgagacatcgcagctaaccagattggttgcatgaccccagaaaccacgttggcaccgtgaatcccgaaaatccaaagaatacatacaacgaattcagcaaccaaggcccctggtaacgtgttactcaacaagcctaatggtttagctaagacgaatgaaatcacgttaggaatactctgcattggtgatgcttcaacagccaaccgcagtaaccacatcaagaataagatgacgaaaccgggtactaaggctgcaaacgagttgctaactgccggtggcacgctatcaggcatcttaatcgtccaattgcgatgcaccatgaaaacgtaaaaatcagtaataaacaacccaatcagtagcgccgtgaataaccccgccgaatcaagttgggttaatggtacccacagtgctcctgccttatcggtgtttaatggaatcgttaagaaccaagcgcctaacgaaacaattgaggcagagattggatcgactttataactctttgccaagttataagaaatcccaataaccgcaatcaagcccatgatatggaacgaggcgttagttggatattggacgatcgttgcccaattcgaaccaaaggtattggccataaaggtctgataacccttgatagggaattgcgcaatgatcatgaagaccgacccgataataatcattggcactgccaatgtcatcccatcacgtaaggcaattaagtgacgagaaccagcaatcttgccaaagaaagggacaagtcggtcattaacaaagctcgacttgttattgttttcgctcatgtcgtgaccccctaaaataatttgttgtgcatattcatttaacgaacattctcaaacaatcagaataatttaagtaagctaacggtcaatcaatagttaaccgtttacataaaattgagttcgtccgttacaaagtagtcctgtcatctgacatttgtacccatgaatacgcttcctacaaaattcattatacctgtcattctcaaaatgtataccctttcactctaaaatgggtgttgttccatccatcggaatttgttccatttttagaacatgttccaaagattggtttgaattacctttacgttaatggctgaataatcatagctaattgttccagataataaacgacgggcaactgggacaaggtgctaccaccactgattgcttgaacttccggggtatcgtaagttaacaccacgtccgcaatcccagctaacgtcgaatgactgctagcggtaatagcgaccaccttcgcgccactctgccgataataaacgctttgttcaataatatcttcagactctccagatactgaaagtgcgaaaaagacggtatccgataaatcctgttgctgaaccgggtggggctgactcgtatcactaatcatcaagctatataaaccaaagttagcgaataaatggctgccatacgcggccaggccagcactcgtccctgacccaatcagtacgaccattcgagcttgatgaaccagttctgcgacccgatgaagtttagccgtgatatcgggtaagttcatgcggtcaaaaaacgtccgcatcggtacaactgtctgagctaacggttgtgtggcatcttgccgtaactgttcttttaatgtgaacttaaattctgcgtagccatcatagcccatgtgctttagaaaacgcaaaatagtcgttgctgagacgtgactatggtcggccaattgccgaatcgtcatagtacttacttcagcgggatgacccacaatatacttataaatttcaatttccaagcggtttaactgctggacctgatcgtacgaaaacattgactcaccccgtcactattgattaattggtctatcattaaattaatatgaccattagaatttatgggaacaaattccgcttattgatcgccccaccgaccatcgatctgcggtttgatctcaagatcctgcatttccaaatcacaagttgctactgcgtcagttaatttagccgtaaattcggccgttttatatggcgaatcaacggaccacgtcttaaagttgggcgttcgattaatacgtcctaacgccgcaatcgctggtacttccttcggatcaacggcgggagccgacttctttacattgatgttgtaaccataatgaccactgtgatacagtgcctgcatggcgtcacgaaaaagtcccatgtcactcacttaccttccattttcatagtccaattttagcataagtccggtgacgctttcatttagttcacacaaatccataaaaataagtcaaaatatcggaaaagcgtcataattattcgctataattagacataaaccagggttattgagaggagcataacattgaaaaaaacgattttaattgttgaggatgaaggtagcctatctggttacttgactaaagaactacaatttgaggatttcaacgttttggtagcggctgacggtttggcagctatggaaacctaccaagcgcatcaaaacgagttgctcctcatcctgctagactggatgttgccaaaacttgatggtatggaagttcttcgccgcattcgcaaacacgatcaagtaccagtcattattatgaccgctagagattatgtcggtgataaagtcgccgggttagataatggtgccgacgactatatcaccaaaccatttgaaatcgaagaattattggcccgaatccgggttatccaacgacgcattgaaaatcaagttgaacccaatcaagtctaccaactggatgatatccagctagataccaaagcccaccgcgttactaacgggcaggaagaagttaccttaactcaccgtgaatatgatttgctgcaattcttcctcgctcatcccgacgaagtctttacccgtgatgacttgcttgaccaagtctggggcgccgactttctcggtcagcaaaatgtcgttgacgtttatgtcggttatttacgtaataaaatcacgacaaccggcgcctccccactcattcaaacagtgcgcggcgtcgggtataaactaagggagccgatgtctgatgcccaaaaataacaccactccgacctatgaacagctgctcaataaggccatccgccgactaatgctgacaattacgttgttggttagcttgatcacccttctgatggtcggcactcagcaaacaatcaatacgactagggaagcccgtgacttgatgagcagtcttaaccaggcgaatatcaaagacgtccccagttttattcaatggaacaatacgacgacacgcaatacgaaacaaccggcatttatccgggtaaccaccaagaaagcaaccttgacgaccgccactaaaacgaagcggacgatcatcactaccccatcgtccaaatcatttttcaccaagcaacagactaagctagtagggccgttagtctacgttcgcggatttggtttcttcttatcttatagtgaaaaagatgggcataacacttaccaactatgggtcagcttaaggcgattgttcaacagtctgcttattttgattctgctcatgctggctgtcacttgtgccgccctggcattggggacttggtgggcccatcgtttagcactgcgactgagtgacccaaccattaaactgttacacgcaaccaagtacacatcgaacaatccggatagcgaccagcccaccttagacgtgcctgctagcccccgcgagatcaacgacctcggtcgggcctttaatgaactgttggtcacgcaaaatcaacgattgcagcatgagcgtcaatttatttctgatgcttcgcacgaactgcgaaccccgattgctgcgattcgcggtaatctcagtctaatcaagcggcggggtgacgcccaccccgaagtgattccagaatcattacagtttattgatgaagaatcactaagaatgcaacatctgattgagaacctacttcacctttcacgagctgatcgcgctaagctagtcttaactgaccaagacctatcactattaatgttgtcactggctgaacattaccagccatcaattgatcaaccattgacgctcgcaattgatccgaacatccacgttcaaggtaatgcggaaatgttacaacaaatcgttgtggccttactcgataatgcccataaatactcgccacatggtcaaccgattaccttgagtttgcaccagactgatcaagcagtcgaactagctgtagccaaccatggtgagggaattccagacgaccaaaaacaggctgtctttcagcgtttttaccgcgttgaccaatctcggtcacaagcaatcgaaggcagtggcctaggcttagcaatcgttcaacagttagtcacattgaatcaggccaacattaaaattaccgacaaccagccatccgggagtatctttacggtcagctggcaactatagtaacaagtactattattttattttctaataattactctcataaaaaactatctgagggcgccgcttcgctctaccctcgtaatcatgatatgaaacaaccgccttctcagttataatgactgcgaaggcggtttcgtgttcatcgtgtgcttattggtgctcgctttagcccgtataaaaaaccgatggctttcagttcatgagattaatcaattgtcgtttcgtacacgtaaataaaatttcaaccctcaatgactgaaggtactgctttcaagattattaggaggtgagttttatggaagtcgttgctgaaagtgttgctggtattgatgtccatcaaaaacagattacagtttctatattggtgggcttggctaacgccaagcctaagaaaatctcgaaacgttttgaaaccattacttgtcggcttaaagattgcggtgaatggcttaagcaacgccatgttgaacaagttctaatggaaagtaccggtcagtattggcgaccggtttggcaaatcttggaacccttcggtttcaagatgatcctgtgtaacccgcgaattgttaaaaacattcctggtaaaaaaactgatcaaaaggattccgaatggctatccgaattggcgcgttacggcttagtttccgcaagttttgtcccgccaaagtcgattcaagcattacgcgaatcaactaggttacgtaagaagattacccaatctatgaccgcaaccaaaaatgaagtccataatcttttacaacgctcaaacattaaattaacgacctatatttccgatatttttaacggaactggccttaaactgctgaagttactcatagatggtgaattcatcactttacaggccatcacaaaatgtcgccacacccgcataaaggctagtgttgaacaattatttgctgcgatggatggcattctgccacgcaacgatcggagattgttgggcttgaatatggaactactcgctgattttaggcgggtattggctgaactggatgctcaaattgatgaacaaattatggaatttaatgatttgtatcttcgcctacaagacattcctggtatcagtcaacggattgctcagataatcattgccgaagttgggtcagatgtaagtccatttccagatgctcatcatttagcttcttgggccggtctctgtccggggaattatgaatctgccggtatcaaacatggtgctcatatcttacatggcaatgtttatctcaaatcagccatggtaagcgcggcgcttgccgccaaacagtccaaggaaaccggtttaaaagactacttttggcgattgcacggtcgcatgaccgcgcaaaaagcgctagtcgcactggctcataaattattacgaattatctacgtcatgattgatgaaggcaccacttatgtagactataaaaaggaccaacgcaaggcaattacgttgatcccacaaacttaaatactagctagtagctttagtatactagtttttttcaacactttcgagtgctttagattagtgcgctcaaaaattattttgtttcaaataaaagcgagtcactagaaaaatctaggactcgcttttggtcttgtgccacccaatcacaaagatacctccaagactattctgaattggtatgcagaaactaattattactaacccatctgcgtggttttatgagatttcatactcaaaatatcaccatccaaatgctctatttttgcttttaaatattgtttttctattttaatttgcgcctcttgtgcttctagatctccgtttaaacgtaacagaaatttttttagtgcaactgtacgttctagtgttacttcttcaggacggaaactgtattgctgaatctctttaattgacgcgcctaattgccggagatgtacaattcggttaaccatctcttgatcactagccgaaaattgtcggataccattttgatcacgcttaatcgggccaattagaccaacactttcatagtaacgtagtgcattattcgacacaccatatttctgagcggtcgccgtaattgtaaacatactcgtatcctcctaaattttgcttgcgttagtgtaacacgaacttgttatactttcaaatgttcaaaaataggaggttgaatttttatcatgaaaacaacaactcgttcttggttagcaatgattgtcatcggtatttttacaattatggctaatctcgatgcatcaatcattaatatcgcgctacctatcatgtcaaaatcacttgcggttccaattagtcagatcacatataccgtgatgggttatatggttattctatcaggcttactggtaacattcggtaaacttggtgatatttggggtaaaggtagaatctttactttaggtatgtatagctttactatcggctcactaatggccagtgtcaacttcggctttgagtttctactattggctcgttttgtgcaagcagttggcgctgccgcaacgctttcaaacagctatggtttaatttcggaactgtttgataatcacacccggggaactgccatgggtatcaatacaatgtttatttccgctggttttgttgccggacctgccttaggtggctttttactacagcagtttgcttggaatgctatttttatgattaacattccacttggaatcattgccattattttaggccacctatttcttcccaaaaatcatggccggcaacaagccactaaacttgatggttggggcgcagggattctattcattatcatcacactattctttgttgtattagaagcagggcagactattggtttcaggcagccgctaattatcattggcttcattatcacattagcacttacactatactttatttatttggaaaagcatcgaaaaaatgcgctattaccactatccatttttaagaatcgtaccttcagcttagcattgctagtcggaatgctgataccacttattaatgcactgttcagctttatattcccactctatctccaagattatttgaactggtcagttggtactactggaatattaatgctgatttttccacttattatggctattgctgccccacttggtggctggttgagtgatcttttctctcaacagcttgttctactaaccggcctagtcctaattataattacgcaaattggcttcttattcctagattcacatacttcattaaccctcattatttctttgttaatttccaacggtatcggcactggatttttcattgcaccaaataacacattactaatgtcagtcgtcccacaaaatcagctaggagtagcgggttctctacagtctttgggaaataatattggcaatattttaggcgtcgcacttggttctcttgcactatttacaacaatgagcatcgatgctggatatcgagttagtacttacttgccagcacatcctgcttggtttgcccatggtttaacctggtcctttagtgtttctcttatttgtgctttattaggctttgccattagtattattaaccgccctgcacactaagctaattcatttacaaataaactcttaacaaccgttttaaggacattaacagtcttgaaacggttgttaatttaactagtacttgatcctgccaaagtattacctgctcagattcaattttcatggtattttttatattctaagtctgaatctaagaatttcttagataaagtttatggaaagtcgatagttcccacggcgatatgccggtaaactatagtcattcaattaaacaaaccaactttaaaaattaactcataaaaatagaatgactcacaacaactaaggagctatgtagatatgttattagatactgatccaaaaattaaaaatatcaccgccgttcaattggttaaggtgacctacccactggtgattgcgaaaactgaagagggcgaattcgttaaagtcaaacttagtgatgaacaactacaagatccattattctgggacacgttaaaaaacatccgccgttcgcaattatgggtcccacttggtcgtcacttccatcaactactctctaacgactggttaatgccagctgcccaataatcattcactaataataacaactaaaaggagttcgattattatgaaaaacacattcaaaaaactaacccttactctaatggctgccggaaccctctttgcgacttccgtttccgcctctgctgacacgacgacaacaaatcctgaagtgacatccaccacactcgtcaacaaagttactcgtgatactaaactcgcaacgggtaccacgacccaccagccgaaacatgatttaacaccacagccaactaagcttgtcgttaaatccacccaaaatcaagtgttagcaaccattgacgctagtagccagagtatcactaagatgaagtatctcactaacgcaaagtagtactgccacccttaatttccgccccgtcacttaaacccttaaaggaggccccgcgatgagtcagctgactaaggccattacccgccaattacaacgtcaatatgccgaaccagttctgaaagatctaaatggcaactggtataccggggccgatgttttagaagacctcgcactgtgtgaaactagtctgcaacaacagaacgtgcatgccggacaagccattctactgagccccgcacaagtcgtaacgattccgggattgttgctcgccagctggcaattgggactgacggtcaccctgacaccgcctagccgccaattacccgagctggcgcctcaaatctacgccgccatggtttattcccctagtcaaacgaaccagttagcaaccaaattagatccccatgaaatcagcgttttaacgctaattctcaatacggcgcctaattttgcttacctggttcacgaccacgcccaaccgttgacacgccgcagccaaccggacctgattctaccagccagtcaactccagttcacccagcctcaactacttaagatggctgagcacggtcaaactagcgcacacgttcacgatttatataaccttgagaccggattgctcccctgcctcacggacctcatcactgcgaccccgtttaccatcataccaactaagcaagactggccatccaaagtcggttaatcgccaattactggtacgtattagcacttggcgctttgaatcggtatcttgcattgcagctgttcccaaaacacaaaatgagctttccaggaattctttgcaatccctggaaagctcattttaatgtttgattatttaaccagaccgatagtctgtaaaataaggtaaatgtttaagatgattagaatcaccgtcacgatccaagccgtccacttaacccagacacggttggtgaagttccccatcagcgcccgattactcgtgaacatgactagcggaatcatggcaaatggtaacgcgatactcaggaagacttgcgacatcgtcagcagatcttcaattttcgcttcattgccatgataataaatcgcaaaagccaacactggtgtaaccgagattaaccgagttagtaaccgttgtgcccagagtggcatcttcaaacggataaacccttccatgataatctgaccagataacgtccccgtaatcgtagaactttgaccagaagacaacagcgcaatggcaaagagcatactgagtaacggactcgcaatcgagccaacgaccttactatcgccaagtgcattgtacaagtcaacgaaccggccaagatcccccttagttccaaagaacagtgcggcgccaagaattaatagcaaactattaacaacgaacgcgactgacaattgaatattggagtcgattgtcgtgaacttaacagccttggcaacttctttttcgtcactccggtcaacttgacgtgtttgtgagattgatgatcccaagtacaagttatgcggcataacggttgccccaacaattccgagtgctaggaatagcatagaacggttgctgacaatccgactagttgggacatacccttttaacatttctggaatattaggttgtgaaataataacttcatacaggaagacgaagagaatcacggcaaccagcgttgccacaattgcttcgattttccggaaaccaagtttcattaataataacagaatcaagacatcggcagtggtaatcaaaataccgacaattaatggaaatccgaataataacttcaaagcaatcccagaaccaatgatttcagcaacatcggtcgccataatcgctagttcagtaataatccagagaaaaatccccattccttttgacgttcgttcccgcgtcaattgtgctaaatctttacccgtcacaattcccagacgagcggccatggcttgtagcaacatggcaattaaacttgataacaggatcacagaaagtaatgcatatttgtactgtgatccacctgcgattgatgtgatccagttcccaggatccatgtacccaactgcaactagtgcacccggtccagtgtaggcaattaaagttcgccagaagctggcatccttagggacccggacactcccattgacttcgtccaagctcttactatcggcacccgttgaatgaatcgccttttcttcggcagctttcatcttagcgtgatccttcgtttttgctgatttcattatgaaaccctctcttctattggtttagaattcaggttgtggactactacgtgatcctcaacagtgcgtccccttaattgagcactcactttaattccaattggtagtatagcaccattaacctattagtcaactattattaattattactttggcatccctaaagcttgttatgacgcggtattatcatcttgtaaggggattctccgtgggctcaaaccattaactaaaaaatcactgagatagtgaatcaattgctcatcactcaaatcatccagttgtgggtagagaacctgttcgactaaatatcccccaatggttgaaaacaccaattgtaaaatcatgcgattcggccaatcaactaattctcgagcggctttcaagcgatccatcgcttcattcgcctgcgccaaaatgctaggtgagaccatccctaagacggccgctcgatcctgagcattattgaaaaattgggacaaaatgacggctaaggaggctcggttacgtgtgacaaatgcgacccgatcgcgcacaagggcgacaacaaatgcttgcaaagtctggttaggactatctaaaactgcctggtccaaagtgttcaacatcgttggcaaaatattctgcacaatcggctgcataatggcgtccagaataccgttcttattaacaaaattatgaaataaagttccttcagcgacaccggcccgctctgcaatctcccgagtgccaacttcttcataacctttttctgcaaataagtcgagcgcggcggctaaaatttgccgttgggtccgggtaatacgaccatccttccccaatgaagccgcataataggcctggatggtttcaatttcactcatgatgataagctccttttttgcagtaactgctcaattttggcatttacatcataactgattcggtcccccaaaacaaccatctttataaaagttacatcattagctttactaaactcgttaattgcttttataagtggatttatttataatcatagtaaccaattaagttacaggaagtgattatatgcgtgtttcaacccgctttagcgactcgatccatttactagcctacattaaaatttacgcagatactaaattaacaagtgacgccattgcccgcagcattgaaactagtccagtcgttgttcgccgattgatgagcaagcttcgacaagccggactaatcacaacaacgcccggtactgctcaaccggcactcgccaaacctttaagtcaaatttcactgctcagcgtcttctacgcaattgagggcgataagccgctactcgccgtcgatcctaagaccaatccggattgtattgttggtggcaatattcaaaccgttctgaaacaatactatcaagacgcgcaaacggcggccgaagcacggttagctaagactagcttacaagacgtggtcgataacattttagtggaacaagcaaagaaagatgcccacaaataagctgccagattagctgacggtgtgcgattgcggaagccagcgcgcatgtcgatactaaataattcaccctgcaagccactccgtttaaatacaaacatgctagtatgtttatgcctaacttggacaaaaaattgcacttcagaatcaacatctgaagcgcaatttttttgttgaattattccatctagtacaactttaataacaataaacggccagctcggtgcatattatccagcaatagggcgcaaagacaatattgcgctgttttcgacaccccatgcgtcacgaatctaccgcggttgctcgtcttgtccataatattccggcttttcagcctggacgggatgggcctgtaaccagctaataatctggcggctgaggtcatccgtcattggtgccgcagctgctatttgtgctttagtaatttggttgacatgaattcccgcagtaattgtacagcttccagctagataacgctgaatccgcttggccattcgttccgaaataaagttatctttatggaagcgaccatcatggctgggaaacttaaccgtttcgggaaccgtgctggcagttagtgtggtcacgtcaccaatatggggattggttccaccggtaacgacgatcaacaagtcatatccaatcacttggagtgttgcttgcatttgatacccggcctgctcagtcgtaaaagttgccatacttaatccccctcccaacggcgatcagtttcattatgaatatgaaacgcatctaaaattttcatggtttgatgattgaccagatcctgaatggattgcggatgattataaaaagcgggaatcggtggaataatttgggcaccgagttttgccaacttcgttagattttctaaatgaatcacgcttaacggtgtttcacgtggaacaatcacaagtttacgttgttctttaatcgtgacatcagcagcccgcgatattaaattatcaccgaagccgtacgcaatccccgctaccgtcttcatactagctgggacaatgaccattccgtcattcaaaaacgaaccgctggcaatcgctgcgccttggtcattagcccgataagtagcatccgcgagcgccgtcagctgcgcgagcgagtaatcagtctctaactccaagttttttttagcccacgcactcattaccaggtgaacttcaacatctggccgctgatgtaacttttctaataagtcgactgcgtaaatcgtaccggacgctcccgtgattcccacaacaattcgtttcatgacaacatcgccccgtttctacagattaataacatgtgatccaattaagtcttcatccttatattaacctgcactatcggttgaaacaaatcgagttttgactggctaatattcttaaatagaatattagccactaataaagagggctgattacgagtcagacgtaatacagcttgcctacttaacttgacgatgaattggctattcattccgcgacgaaccaattgtttcatcatattaactacaaagaatatatccatcagtttaaatgttaaaagccaactaatgggtgaactaaaatcaaacaaatacattattaatacataaatacactccaattatttactagttaagtcaatttttcgaaagaaaatcaagttttccttggaatcgttttaattgtattttggtttaaaacagttagttgctagataaaccagactaccaatgaacgtaatgcccgttagcaataacaatccaatgtgtttggactgacgagctatagagacatcaatataagagtccccggccggtaaagctgtttttaattgtccctcagaatatttaaagttcttctttttaccattgaccttaaccgaataatttacatttttatagccaataacaggtaacttaactgatttcatattcttctgatgatatttaaaagttactagttgatcatttgcaaatgtgtttttgaacttttgagaattatcagcatcaaattgcacagtttttttggttgcacgtgatgctgtggcaaaattaagcgcagcactcactttcttcaaagactgaacagactcagcctttttaatatggtaatcaggcacttgtgtatcgactaatcgcttttggtagttagcattagttaaatattgatttcgacgttgttgtgcaagtgaattggacttcgattgtttcagtgcccagaaataattttgtttagtttgattatgagcagatattacgccactcatgccaactgtgattaaagcaaaactgataaaaagagtcgttgagtatgagtgccagttaatttggactaagaacaagatagaaccaatcatgagtaataacacgacaacggttagaaaacgcattgtaaattgaaataaacttactggggtgttagctaaaaaatcaccatcaatccagttctgtgataacacccaaatacttgcggcaccaatgatccaatagcgccatgaacctgtttgatttgaaattagctgtgaaattaagtagagaaaaataaaggtcactataatacctaaatgagcccctctagctaactctccaatgttattagttaacatgcgattcaaactcgttaaaggatccagactaataagcagtcgagcaggtgctaccatcttattgtgtaatagccagtcaacaatattatatagggaataacttgacataattatactgataaaagcgccgattagtaactgaagcaactcatgccaagatagatttcgacaaagtaacctaataatttcaagaaaactaattaagactgtaaatagcactaatgaaaggatgtgggaattggcaactagacccatacctattgcaaggactattgtgccttgtttttttcgattccaaatctgaaacaatcccaacataatcaaaggtagaaatgtatagccgagcgcttccccaagtgccacacgagtatacattagctgaagatgataagcactaaattgatagatagagacacttaacaaaatgattaaccgattacgagtcaatgattttgctagccagtatgaattaaggattgtaaaaaaattcatcaaccagaaaccaatagctagtgcaagcatggggttatcaataatgagccgaggtattatatagattaacaaagttatccagggatacatcgcattcatcgcaaccccttgattgttaaagccgatgaagttgatgaggctcggagcccgtccggcattaaatgcttgatataatgattccaggcgggccagatgaacaccaccgtcattactgagttcaaagaaatgtccactaaaggctggataagtcgaaatgagagccaatagagaaataattattaatgttaaggttgcttcgaagtaacgactatttttcattttgagaaacatgcgtagcccttccttagctaatatgattaatatatccaaactagtgtaactaagtcgaaagttacattaatagtttctttgtaaagaatacacccggttaaattcaatagaatcagcgggctgaaatacttttattgggaacaagttaaactaagacgcaatattgatactatatcttgctgaatgttacttgtaattattttcaaaaaaagaggctcacgactgcctcaaaatgagaaggttcgagtctctttctatgcgctataacgtaaatcacactcataaaattaataaacaagtagaatctcaaagaattgccctagtttcaaattcatttaaagcattacggttataatcacgccaatcaaagcgttcaaaacaaacctgttgttccatatctagcacaaccattattgctacatcactttgtacatcataatgagcaagttgactgttctgagcggcacgctttccatcaataaacaccgcgtaattcggatagctttcaacgtgtttaatttcaacgaatgcacgcccattgttatcatttcctaaaataatatctggatttttccagtcatctgagctagtaatccattgaccgtcaacttgagtttcagcatgaaagattttcaatggttcttttacagtttttacatacttgatactgtccttggtctcaattgagagagctaaagtattcgccaaactatttggatttgctacggcatttttaccgctcagcaagccaaaacgtccacccttgattacatcttgaataccagcaacatctgttccaacaaccggcttgtgtgcaagcaaagcttcaataatagcaagcccttgcccctctgtaactgatggcagtacaacataatcagtaaatgacacaaatttcattggattctgcaaaaatcccatcatgaacactgattcatctaatcctaaaccggaaataagttgctctacttccagtcgtattggaccatccccgacaatatataatcgcgtcttcggataattatcatgtactaacttaaatgcttggattaatcctaaatgattcttttcaggagacagtcttgccaccgtcacaaaattaaaataattctgatctacaggatggaataattgagttgtaataattccgcttggtgtctctgttttagtaagctctatcagtgaatcaccattatccacttgttgctttacctcagataattctttttcaatttcggcgccattaactagattctcaacccatgtaaacttagcagaatcagcatactgactcagatcttctcgattttgtttatcagctgattgggaaactgaaatgattttgtcaaaatattgataataagtaaacgtaacacgcagattcttacgatgcttgtatcgcccattaacaattttattatattcatcccacatagtattgtgtagaaagacaaccttctttggaactggtgataaagcaaataatccagtaatagctttgttgtagccaccaaagtcaatagcttcgtatggcataaaattaccaaagatacgcctaaaattcagctgatacgttgccttcatcttattttggttaactaactttgaattaaatccgaagtggtagctagtgttctgattataagtatcaaagaatgttctagttgcccatgaaaaactaaaaataaagtgtacgctgccgggtaaacgactcatattatattctttttcagggcgcatccgcggataatcaacaaacactaattcatatttattagtgtcaaaatttctagacaaattaataatagaatttgtaatcccgttattatagaaacctccggcataaatcaataacttctttttattattgttgaaattaagttgctcaaccgatgacgactcttcaaacaatacttgcactgcacgttcagtcgcttgtccgtcatcataactcaagaattcggtttgataatcattgtactgttgttcgtaagtcttggcccacgaatcaaagtatttttgattacagtcattaagcaattgatcaaacttatccgtgaccagtcccggaagtgtatcaagcggcttgtaaaagcctcggttctgtgcgtagctgtccttatcaggaacataaaacataacgggccgtttaatcggcaaaaagtcgaaaaagatactggaataatccgtaatcaatacatccacaccacgtaacaatgtgttggtatcaatggcatttgaaatcaattgatcaccatatcccattttaactaatttatcataaataaaataatgtacttttaaaaatactttgtagccagatggaacacgttcctgcaatcgttggacttcatttaacaactgtaaaatatcagcttcagtagtatattccacatcttttttccaagttggcgcatacaagattatcttttcagctggaagccccaagcgctctttcaacgcttgcgtatcctctgaaactagtgtccctagtaagttatcaactcgtggattaccagtaatatagacttcatttggaaaaataccgtttaaatcatggctcgtaattaaatgctcagccgtaaacttgttaggcatagctaagacatcagccgccaataaattacgctgaatattcttatggtctgccctacctgaacctttaatatctaatcccagtgtttttaaaggtgtcccgtgccaagtattcagataccgttgcccatcccttttaataaaatagggcatgaaggaagtatcgttaattaaatactttgaggtagctaaggctttcatatactgacgtgattcgtacttaactaaatatacccgatgtctcttggtatccgccataatatccgcaggaattgtatctttgtctttgtatgcccaatagtacgtataatccggatattcttgtaccatcttttgatacatcgcatacacatttccagtcaaattgacagcatgatacgattccaagaaaacagccttttcttgaactttgctatgtttcacatagtataaataaacattaatttgacgaattgccggcttagttacaaactcccgaattggccgtgcaacaaacttacacgcgagtttgatggtattcatctttcccataatatatatcattactccttgtacttgactacagtactctagccctaatggattagcctgtataattatttgcgttctgatctatgctagtaatcaacttcacaactcgttgactagccgttccttgctcccattccgtgaactgtgtccgaaatgccatcatcttggctttttcgtttggataaccatcattaatcaagaactgatctaacttggccagaaaatcctgctcattggtgacaattggaccaggaaccttgttgtaatcaaagtagaatccgcgaacatcaccctgataatgcgctaagtcataaggataaaatagcataggtcgattcaagatagcgtaatcaaacatgaccgaagaataatccgtaatcaataaatcactaattaagtacaaatcattaatatcttcatccacacataatttaacattgtcctcaaagccttggatattgatcgactcagctactaggtaatgtggccgaataataagcacatcttccttattaagccttttaacaatagcggccaaactaaaaggcaagttcattttatacatacctttgcggataaaaaagtcatctcgccaagtcggcgcatataaaattactttgcccattttattgccaacaattctttttttaatcgctgcaatcgcatcataatcctggcgctgatgcactaaccgatcgttgcggggatacccataatccaagaactggttgttaaaatcaaacgctcgtcgaaaaacgtcttttgaaaactgattgggtgcaattaaataatcccaccgtttactctccgtcgtgaaattctgacgatactgacttgtatcggtaccaggcattgaaacttttggaatatcaatccccagacgtttgagcggcgtaccatgccaagtctgaatataggtcgttttcgcattcttcttcaaccaatacggcatccgcgcgttcaggacccagaattctgcaaccggtgccactaataaccatttggctgaaaagcgtggaataatattcaacttaggatacttttcctgggcttccgcaaccaactgacgcttaacaccccagactagcttccaatctggatgcgcggtctgaagtgcttcgtaaacgtatagcgggttatccattggaactttaccattaaacgcctcaaataaaataacgtgttttctcactgggcacacagtcgcaattacattgaacagtcggcgataaacctgactgataatatcttttaatgccattttattgaattccccgtcacacgtttatttttgattgaaattcaagtcttgcttaatcttagtcgttgagatttcaggagtccgtggtaaatagatgacttcagcgtcagtttgttcacccacgaaatcaaatttaccagtccagtcatcacccattacaaagcgatcaatttggtataatttcacgtcactcactttttgatcccacgacttttcagggatcactaagtcaacatagcgaattgcttctagtaatgccttgcgcttttcgtatgaaaaataggccttcttttgcttgctgtcccagttgaactcatccgttgatagggccacaattaggtaatcccctagtgatttggcacgcttaagtaattcaatatgcccataatgtaataaatcaaaagttccgtacgtaataactcgcttcatagtaaaactcctcctaaaattccttcgttaatttttattaagttcaatgtacacacctgaatgtaaacaaggctattatatcatgaaaagattgactacacccatcattatacaattcttaatgagccgcgctttgtatattttatattttaaaacaagcgaaatgcatatatcgcgcaaagacttgcccggattgcggtaatcatcattgcaatttgtcatttattcacccgtgccttttatgttgcaatccgcataaattcccaagaagctaatccacaatgatttatcgttaaaaccagacattcaatgcgccacaccacgttttttggcctataattaaggtagtgtattaatgagggagggatgtctatggcaaaacgacgaatcacacacgacccacaccagtttgttaatactgctactgaccggcgacgcttacaattggctgtccaattagccttgccaacctgtgcgcacgtcttagcacgcaattttgcgcgttctagtgccagctcttactggctactaatgctaaagacgccggggacggctgccccgcgctttttgaccttgcggatcgcggatcatttgctatggctgacgaaccatgatcaattaaccattagttgggaggctggtaattttgacgccgttcaacggaccttgcgtcaagaattaacaccagccactctgcaacaatacagttatcaactcacgacaactgatattatgacactgcgcttgattctgcatttggaacaacatcagctcatttggttggtccaattagcacctgaaatcgctaaggcctacaagaatcagcattttgaccttcgtgacgactttggtcaggccaaattgttactaggcaacatgaataacagtagtctccaactggtgccagttaagcaaccagctttccaaaatcatcttggacaatacttcggccgcaatctcctattctcacagttcaccagccaccatctattgcgactattgcccaccaatcaatggattcgacccttactaaaggtgttgccacccacaccaaatctggaacagcaactagcagtcctgtatggcaccgactttgtccgcatttatgttgaagcgattagttcataaaaataagacccccgctacgttcagcaggagccttattttagttactgactattagtcgcttttaagttttccttaggacctaacaacttatccgaaaaaccaaatacataaactaacatcgttgcaatcactagtgtcccgtaatgggatatcaaataaccataaaagtttgacccgatgccgacacccggggtgataaacgcggggaaaccgatcaacgaccctgacaaagcatagttattaacgcgcaacaggccggtcagtaagccacctagaccactcgcaatgctagcaacgacaaagacccgtttgtatttcaagttgaccccgtatagcgccggctcggtaacaccacaaaaggctgaaattgcagctgccagtgagatctcctttaggtgcttatccttagactttaagaagacggccaacaccgcaccaccctgagcgaccatggtaatcgagaggattgcattcaaataactgtgcccattcgtcgcaatatcattgatcacaatgggaataatgccccagtggagcccgaaaatgaccatcgtctggtataaaccaccaataaccaatcctgataaggccgggctaaaattatagacggcgaccaaaccgttggccaagcccttactgataatcgtaattaagggaccgaccaccactaataccactatcgccaaaatcagggcttcgataatcggaataaagacgctccgtaaatacagcggaacaactcgttttaacccccgctcaacgtacacgcctagccatgcggccacaatcatcgggaacacggatgccgaatacgacattaaatgcgtcggaacacctaagaacgtgatttgggccgtggctcccttactagctgccgttatcagacttggatagataagaatagcaccgacaatcgccagcacgattggatctgaacctaactttttggcagcagtaaagcctaggacaactggtaaaaagtaaaacgttgcatcagctaccgcgttcaataccatgtacgtcccactcgtgaccgccaagactttgaagcccgttaacgcggccaagattccttttaaaatccctgaacctgccaaaatgccaatcaccggaatcattgccgcggtcataacaccaatgacaccactaatgccattacgcacgtggcttagccaattaacgtcacttgatgcctcctgaaccggtggtactggcactccgtccgcaaattcaggccctagttgtgcgatcactgcatcaaaaacatcgttgactgccggaccaatcacaacttgatactgaccaccggcctttgcaacatcaatgacgccgtccaagttcgcaataaccgcatcgtgcgctagtgcttcatccttcaaataaaatcgcaaccgtgttatgcaatgaatcacgctattaatattttgctgcccgcccacattagctacaattgccgtggctaatgccgagtaacgcgtcgttgactgcggtaccgctgccactaccggtgacgcggttgttgtcactgttatcaagtgagccgttgcgacgactgcaccggccgcgacagcttgtggcagtggggctagcgtcaagtcagtgagtacccgctgagcgttcgtcacgacaatgatcaccgtggtcggtttgtgggcctgctcgatagcagctaaatccatgtcgactagtagtgtgccagccgtcacctcatcaccgaccttcacgtgaacttcaaacggtgccccattgagtgccaccgtatcgacacccagatgtaccaacacttcgaggccagtcgtagtcaccatgccaattgcatgtttggttgttgcgactactgtgattcgaccactaactggtgccaagatgtgaccagctgtcggctgaacaccaaatcccggccctacccttcccgccgcaaaaacaggatccggaaccgttgccaatgacaatacttgaccagtaactggtgctaaaatggatacttcatcgatttttcccataatcgtcatcccccatgtaaaacccttaacctaaccttcaaaaatccttaagacgaccgtctcacgtccaatcatgatccattaaaattctatcatcacaattagaccaatctccatcacttaccatcacttcgttagggcgactaaatatcaaaaacaagtatttttccgaatcggaaaaatacttgtttatcctaacgttgattaattatttgacgtcgccattaactaggcggttgcacctaagtgtcgctttttaggcgctactttaactgcatttgcatcctcatccttaaaaccaaacatccaagttaaggcgaaggacacgacaatcgtggctgcggatgcaatcaagaaaccataaaaactaaagtccaagcccttcggattaacaaaggacgtgaagccaatcagtgaacccgtaaagccccacatattgacattcatcaagccggtcaagaagccaccaactgtcgccccaatactggcagtcacaaaggcccgaccatatttcaagttgatcccgtacatggctggttcggtaacaccacagaaggctgaaatcgttgctggccaagcaagttcttgaatgttagccagctttgactttaaggcgattgcgaatactgcgcccccctgggcaaccatcgtcgctgaaacaatcgcgttcaagtaactgtgacccgtcgttgcaatatcgttggccacaatcggaataaccgcccagtgcaacccgaagatcaccaatacttgatagaagccaccaatgattaagccagaaatcgcagggctcaaattgtagacccacacaataatatttgccaatcccgttgaaagcacagtaataattggaccaaggaataatagaatcgcaccggaaacaatcacaacttcaaataatggcacaaaaatcattcgtaataccgttggaatcacccgttttagccatggttccaacttacttgctagccaggcccccgcaatcatcgggaaaattgaatacgtatacgaggcaacgtgtaccggcaagccaaagaagttcgcattgattcccattcctaaaagcgtactcgtcgctttaccacttgccatcgttacaatagctggataagtcagcaccccaccgatgattcccataatcaccggatctgcccctaactttttaccagccgtaaaaccgacgaagattggcaggaagtaaaagaccgagtcgcccatcgcattaataatcacgtacgttggtgcggtcgggctaactaaattaaacgtggtaagtaacgcaagaattccttttaaaataccagaggctgctaataatccaatgacgggaatcattgaacccgtgataacaccaattaaattactgataccccatttaactttgccccacggcgtcgttggccgctgagctgctgcggcagtctcagcaacagctttagccgtctccgaatcatttgaaaatcccggtccgatttgcttgatgatcgcatcatagacatccgtgacagcaggaccaatcacgacctgatattgaccgcccgcttttgctacgtcgatgaccccttttaagtcccgcacgacgtcatcattggctttactctcatctttcaaataaaaacgcaagcgagtaatgcagtgaatcaaactactaacattctcgacaccaccaacattagccacgatgtccgcggctaactgatcatatttacccgcttttggtaatcgattctgccgcttagcgttaaatgtgttggcgttcagacggcccgtagctgtcacgtcaccggcagcttttgcccccgtaacgacgtccaacgattctaatttatcactagtgttagtcactgctaaaatcactgtggtctgacgattagcggcttgaatagcagctaaatccatggtggcaatcacgtcccccgcctgaacatcatcgcccgcggccactttgaccgtgaacggggcaccctttaagtcgaccgtgtcgattccgagatgcactaatacttccaaatgatcatcaggcgttgtgaacccaatcgcgtgtttcgtctcagccaccatcgtgacctgaccactgactggtgcaacaacttctccacttgaaggttgaacgccaaagcccagtcccatcataccggctgaaaagaccgggtctttaaccttatttaacgcaataacgtccccattgaccggcgacaaaattgttactgtttgtgcctttgccatacccattcctccattcttaacctaacaacagcgcaaccgcttgatagggttgcatcgtcaattgtgctgtgacattaacatcttgataattggaaagtaacacctgtgcaccgaccatttcttccggaagtgtcaccgttgttgactgaccataaaaattattaagcactaataacttttgttggtgatatgtccgccaatagccgaagacttgcggatcatctaagcgccacgattgataaccaccatccgcgacgatcggcatcgtttttcttagcttaatgagccgttgataatagtcaaaaatctcgccactagccaattcatgggccacgttaatcgtcgcctgattagtcggtgtcaaccacggtttaccagtagtgaaaccagccttggcactatcatcccattgcatcggcgtccgcgagttatcgcgcgccttggtcttaacgatcgtaaacgcatcgtgatgactgtacccactacgaattaaagcccgataagcatttaatgcctcaatgtccacgtaatcagccatattgtcatagtccggatcagtcatgccgagttcctcacccatatagataaatggtgtcccacgcaagaggtgaatgaccgtcgccagcatttcagcggacttgacacgataacgaccggcgtcaccaaagcgattcagcgctcgtggctgatcatgattattccaaaacaaagcctgccagccaccaccagctgccattccaccggcccaactatctaataattgcttcaatcgtgggaagtcgaaggccattcgggaccacttccgtccatcaacataatccgtcttcaaatgatggaaattaaagaccattgagagttcgtgattagccggattagtataaccaacactgtttgcaacggttgttgaagacatctcccccactgtgacgctatctacatcctggccgaagcttgccgcgttcaattcctttaaataatcatgaacaacgggggtgtcagtatacaacgtcttgctagggacccccttaggtgcgtccaccaacttctcagctttaccggtaacgttgatgacatcgaaacgaaaaccctgcacgcccttttgccgccagaaattgacaacggcggcacacgcttgtcgtacggccggattatgccaatccaaatcggcctgagtcggatcatataaatgtaaatagtacaaaccagtatcaccaaacggcgcccaggccggaccaccaaatttagattcccaattggtcggtagactaccatcagccttgggaggacggagatagtaaaacttctgatacttctcatcacccgccaaagccttttgaaaccactcgtgttcagttgaagtatgattaagaaccatatccaacatgaccccgataccatttgccttcagctttgcaacgagttcttcaaaatcagccatcgtgccaaacatggggtcaatatggtagtaatctgcaatatcgtaaccgttatcattttgtggtgagacaaaaaacggattaaaccaaatcatgtcaatattcaactttttgaggtagtcgatcttttcaataacacctcgtaaatcaccgacgccatcgccattgctgtcgtaaaacgacttcggataaatctgataaatcacttgttctgataatttcatgcgctatccctctcatgccacatcttatttcttagttcgccgagcaaaatcgcggaaactaaagcggtccgcccggtgtcgtgattccgtatactggaacgctcgcgcatccgtgaggctcgtcacgcttcgaacaactgccacataggcgcccttactaatagcgaggtgttcgcggtcctcatcagttgccggcgccatcgtaatttccttcgtcgcgtaaccgatcgtcaacccaagctgattttcaaaatacgcgtacagtgagtcttccgccgcttgcttgggaactttcggaacgatcgatttcaaaatataatccttatcaataatagctggttcgccatcgatcactcggactcgtttgatggccgtcactggcgcttccgtcaattcggtaccaagtgacgtaaagtcagcaaccggtaacgttgcatccggttgatagtcataaacaatattttgcgtcttaatgtgtaacttttcggctaactctttataactcacaatgccagaaactggaaattcatactgtcgatgctcaatcacaatggaccctttaccacgaattttttgaatatagccatcctcagccaatgtcgctaatgctttgcgcccagtctcacgtgaaatcccatatagctcacaaagttgatgttcactcggcaaataactcccgatcgggtaaacctccgcatcaattttctggagcaaatcttgataaactaaggccgctttattcacggcaaccacccctttgttatcgttttcatttatgaatatagacttgtttagacaagttgtcaatatttaagtaataacccaattaaatttgtagattataccagccagatcaagtctagacatgtctagagttcacaaaattcgagcttatatttcagtattcaataactacttcataataagtgccagcatctatacagtattggtttaactagcaggatagtccgcaccataataaaaaatcgacattcgcagagcgctaacagcaatctccaaccaatgtcgattctatatctgatgatttcattaatattactattttcgcaataaatctttcgctttcattgttgctacttcttttttcatttttctccttcggttcacgagtgcatctatccagataccattcagcacggcttcgccaactaacaatacggttactattgataataaagagacctcttttgtaaaaacaatgtaaataataaagcctaaaaagccagctcccggaattgccccaaaccaccttggtaagtatcgatctaacatatagagcactgcaacgaccaacataccaagcagaattcctttaaaatcactcatgttgttcctccctaaagtcagtaataatctgttttgctacctctaatgataatttctcatcgattaccaatttcataaccttcgtttcaaacgtatttgcaccgttgtcctcaataaagttaattttttgaataatcgtgtttaaccgcattcgcacggttggataactcacttgataaatcttagcgagttgttttagagaacctgaggcaataaccaattgtttaacaaattcctgatcctcacgttctaaattcacaaaccagtccatagcatccctcttttttaatattgtttattaaactttaacattgtttattataatgtcaataaaaaagcatatatttgataactgatacaatccggagctattcaaataaagacgagtactctaatccaaaagaattacagtactcgccttatttagaatattaacgctactagtctcagtaaatttattagctgacctttagtgattcaatccaaatgcctgattatcactagcatccgcgctagctgcatcactagctgcttgttcttcggccatcaaccgagcgcgttcatgtttgttataccaaggtgaaacagtgaaagccaagacatcgttcatcagataaacggaactattaatgaacattgctagtgtcgccgaaccttgacggaacgagatgaaccagaggaccatttgtgctaaaccagaggcaatccaccagaaatactggttgttgtaacggaggaagcaaataacgccggccgttaaacaaatcgcaaaactaatggcatcgacccatggccggggatcatcagttaaggcaccaataagatagccggagatggcataaacaactaaagttgcgacaattgcgacgatccacgtcttacccgtaaacttccgaatctttgaaaccatgttgacgttccaattagcacttaatagtactggaatatcaagcgttacgacgtaggctaattgttccccaatgcttaaatagttcttagctgaaaaaccaactacgatgaagcaagcggcggagatgacgcctaataatccattgactgacttagccgcattaatggctaacacacaaagaacacccaaagtggtcccaataaatgttaaaatagacaatgctgtaattggcgcacttactaacgtcattacttgacatcctaggctaaaatagaatagatagtagttctgttgtggccaaccttttagttggtgtgataagaatttaaaataattactcaaaatcatgctcctctttccgttttcatatgcggttgtaggtgtctagttggccaaccagtcacgtcacactactacatgtagtgtttccgtttgaaacaacacaatatattgtatcattatcttggccgatgaaaagggtaaaattccaaatttatattgaattgtttacaattaatccaactgcgccccggcaatttggtatttttggcgtgctgatttttttatatttttttgatttcggcctactgatagcgttgtcaatatcaggtcaaaacaatgcgttttgtcgcaatacaatgcttgcagtatactggagaggaacaaacttttagcatcacaatataattaatttttttggaggaacctcatgattacgcttaaatcagatcgcgaaatcaaagggatgcaagctgccggtgacatcatggttggcctgtttcacgcccttgaagactacatcaagcccggaattacgacttgggatgttgaccactttgcctacgaatacatcgttgcacacgacgctactcctggcgaactcaactttgaaggttataagtactcaacttgtgtcagcgtcaatgacatgatttgtcacggctgtcctagtaaagatatcttggtcaaagatggagacttattaaaagttgataccgttattaactaccatggctaccttagtgactcttgccacgcctttgttgctggtacaccatcacccgaagttaaaaaactcatggaagtgacccataaagcgctatacctcggtattgaccaagccgttgttggcaaccgaattggtgatatcggctgggctattcagaattacgctgaaaacgaaatgggttacggcgttgtacgcgaatacattggtcatggtattggaccgacgatgcacgaaaagcctgatgttccacattatggcgaagctggtcacggcacccgtctaaaagctggtatgaccattactatcgaaccaatggtcaatattggtgactggcgttctggcgaaactgccgatgacggttggactgttcgcactttagatggcagtcttagctgccaatacgagcacacccttgtcgttaccgatgacggtcctaagattttatcatcattcgataatgattttgatgctaaatacttatggaataagtaatatcatttaaattataatcacgaacaatcccaccctagtttagtcacttgctaatcagggtgggattgttttagttattatcaacagcacgttcactagctattgtcagaataaaactagttatatgtgtcttggaaaacgtcttgattataagacatgaaaaactgatattggataaattttaacatctttatcctcggtcacaatcaactgattcaaccacctaatatatttattttaatgacaaccgtttggcaaaactaacgctgattcaataacgttctcagccaatcttcatcttttaccgcttattgcaaatcgtcattcaccacttgacgcgctcaaaatcatcttgtatagttagtcccaattaatccagaggaggatcagacatgactcaattaacaagtagtgctttgaataactgttgttgccgaactgcgcgcttatcgcgatgttcggcctgttaagcattgactttttgaggagtgtcatcctaaaaatcaatgtccagcatggctggatattgtactgggcgcgaggaattcattcgaattctcgcgccttttttgtcgcttttggcaccccaccgcagcgattggaggaatttatatgctcattcagcacgttcaagaacttatcggccacacccccctgatggcgttacccatcgaggttccaaatcacagtcacatctatgccaagcttgaaatgttcaaccccggcggcagtattaaggaccggctgggagcctatctgattgaagacggcttgcaacggggccgggttaacgccaagacaacgattattgaaccaactgctggtaacaccggaattggtttagccttagcaactcaagcgcaccacctacgtaccatcttagtcgtcccagaaaagttcagtatggaaaaacaagttttaatgcaagcattgggtgctgaaattgttcatacacctagcgaggaaggaatcaaaggtgccattcgcaaagctgaggcactagccgcaacgatttccaacagttacgtccccatgcaattcaagaatccggctaatcccgcggcttattaccacacactggcaccagaaattctggcggacatgcctgcacctataaccgccttcgtcgctggagccggtagcggtgggacatttgccggagtagcggcttatcttcaagcccaagattcagcaaccaaagccgtagtcgttgagccagaaggttccattttaaatggtggaccggctcacgcacatcgtactgagggaatcggcgtcgaattcatcccaccatttttcgatcaggttcgcatcgatcagacactgaccatcgcggacgatgatgcctttgcccaagttcgacacctagcccgtgaccacggtttactgattggcagttctagcggcgctgcgctagccgctagtttacaacttgccaccaacctgcctgccaatagtcatatcgtgaccatctttccagacagtagtgagcgttatctgagccaaaaaatctatacgaaatgaggactttaacaatgaaatttgaaacccaattaattcacggtggtatcagtgaggacgccactactggcgcgacttcggtacccatctacatggcctcgaccttccgccaaacaaaaatcggtcaaaatcaatacgaatattcacggacgggaaatccaacccgggccgccgtcgaagcattaattgccaccctcgaacatggcagcgctggcttcgcatttgcttctggctccgctgccattaataccgtcttctcactattctcggctggtgatcacattattgtgggaaatgatatctacggtggcaccttccgcttgatcgacgccgttttgaaacactttggcatgacttttacagccgtagatacgcgtgacttggccgccgttgaagccgcaattacccccacaactaaggcgatttatttggaaacaccgacgaacccgttattacacattacggatattgctgccattgcgaagctcgcgcaagcacacgatttactgagtatcatcgacaacaccttcgcctccccatacgtccagaagcccctggatttaggcgttgacattgttttacacagtgcttccaagtatctcggtggtcacagtgatgttatcggtggcttggttgtcaccaagacgccagcacttggcgaaaaaatcggctacttgcaaaatgccatcggtagtattttggccccgcaagaaagctggctattacaacgtggtatgaagactctggcattgcgcatgcaagcccacctgaataatgccgctaaaatctttacttacttaaagtctcacccagcagttgctaagatttactatccaggcgatcctgataatcccgatttttcgattgccaagcaacagatgaatggcttcggcgcaatgatctcgtttgaattacaaccaggaatgaacccccagaccttcgttgaacatttacaagtcatcacgctcgccgaaagtctcggagcattggaaagtttaattgaaattccagccttaatgactcacggtgccatcccacgcacaattcggctacagaatggcatcaaagacgagctgattcgcttatcagtcggtgttgaagccagtgacgatttgttagcagaccttgagcgcgggttcgctagcattcaggcagattaagctggtgtttcagacggctcgtgccattctcaatcgtgaccccgccgcgatcaatttgcggacagttatgttgacctatcctggtattcacgcgctcgcctggtaccgggttgcccattattttgaaacacaccgtttaccattattggccgccttgctgagccaacatgcggcccggcgtaccgggattctgattcacccggccgcgcaaattggtcaccgggtcttctttgaccatggtattggtactgtcattggtgcaacggcggtcattgaagacgacgttacaattttacacggcgtcactttaggcgcacgtaaaaccgaacaagctgggcgccggcatccctatgtttgtcgcggtgctttcattggtgcccaggcccaactcttgggtcctattacgattggcgccaacagtaaaattggtgctggtgcgattgttttagacagcgttcccgcccacgttactgcggtcggtaacccagcccatctagttgccactcaattgcatgcttatcatgaagcaacaagcaatcaagcctgattattatcaaaactgcagcttataataatcggttgttggtatcaataaaacgtgcttataaaatcaagattgattttataagcacgtttttacgttactttgaaaattcatttattatccacaattatttgacaaacttcgctgcaaattcgctgaattgcttaccagcaccagctaagaatgattgggtgccttcatttgtgatatgaccattttcatcagccaacttatcagtattaccgatgtacaattctggttgttgcatcgttggcatgtctaagaagaccaaggattgacgtaaaacatggtgtgctaagacgccagagataccagagatcgattgggaagcaaccaaagcaggcttgccgccccaaacactttgaccccatggacgtgaagcaacgtccaaagcattcttcaaggctgctgggatgctacggttatgttcaggtgtgacaaagatgaacgcatcttgagccgcaacggcctgacgaaattctgtatattctacgggtgaatccgcatcgtagtcttggttatatagtggcaacttagcgatatttaagtacgttacttcagcgtcgtctggtaacccagcaacgatggcttcagcgacccctttagaataagaatttttacgaatagaacctacaattacaccatattttgtcatatcaaacaatcctttcaaaactaatttcttcgtttcacttactaatagtaagtatatcaagttgttgaaaaagtgcaaccattttagcctatcaattttcaaaatcacttgttcaatcgcccaaaaacgttgttaaatcaagacttacgctccagaaaaatattttagtctatgtctaattaccgacagaaaaggtcatcggagtatcaatgattccgatgaccctttctttattttcaatacacgtctaatcgtcacgcatttcagcgcgatatttgatcaacccttcgtttaaaaccatcaaacatctaagaaatcttgataatcattatcaacttgttcaacatacgccgtggcccatttagccatggcttcatcaaacttcgccgaatttccaacgtatccccgaatcatggccgccgttggactttgcgcgtgagcctttgccaaaatcattgcgcacgtatttgcataggcttggaattgaccccagtctagggttggaatatcaatggattccttcatatcccgaaattgacggacataaaaactcttattttccatttggaaatagcccaggaacgcatccgaggttgcttgtaaaatgcgttgcgaactgacgatccgttgcccttccgtcaattccatggcggccgttaacgctggccgcgactggctcccgactttccgcgttggtaaagcttccttgatttgtaacaccatatggctaccatccgtactcgtcagaagaaccaagtaacatagtgacccaaaactcccgacgcccacactatgccgaataatatcagtaacttcatattgcgacaacagcaaagcgacatcggtccgtacgttcaataaatactcgctaattccggcctttagcccttgataagtttgccgatcaatatggacagaacggggcgcgttctccttaaattgccgttcaccgcgactattagtgaccgtaaacttacgcacaacttgttctgaattacgtttttgagcctttttaaccaaggatgcaattagatcggccgtatcttcgggagcaccaccgaagttcaagacagcctgaacttcgttatcgcgataaaaacggtctaacgtcgtctgatcaaacatccgtttgagtacttcccgataactcgcactcgccgcctgtatcaatttttcgaccttttttggtttaaagttagaatcacgagcagctagcaacacactaactaataaccgacgtaaatcccattcccacggatggacgccagcttcgtcaaagtcatttaagtcaaataccagtcgccgttctggtgacgcatagaatccaaagttaccaatatgagcatcgccacaaactacggcgggaatttcagtggacgactggtaatccaaatcgtaatccattaactcaactgatccccggaagaatgcaaaagccgaagtggacattcgttcacgccgcaatggtaatagttctggtaccagcatctcccgcacatgtttcagataatcactggcgtttcgcttcaccggtgtaaatgcccctaatttttcaaatggggtgacttggcgccgcgcctttcctagcgcaattaattcagcaaccgtatgatgttgtcgaatatgagttaaatcaagtggtggcatgagtatcaaatccttttatgatttactaattttattatagcgatatcttccaacgatagaaaataattcagctagttgagcccgcttctcgcgtcccaattattgaccagctgacgccaatttacaagcaattttcatgataaaacggcgattctagttgacgtacccctcaaagtcacctacaatttaagttataaatgataccgctttcaaaagcgaggaggtcacgtattatggcaaattctgaaaaaacattggtcctagttaaacccgatggtgtcagtgaaggacacattggtgaggttatcacccggttagaacgcaagggttatcaaattgccgccttaaaggttattaaagcaaccgcggagcaacttcaacaacattacagtgagaaggttggtaagccttactttaaggaaatcgagacctacatgatggaaggtccactcgtcgccattatcgtaagtggtactggcgtcgtcaaagcggtgcatcgtttagctggtagcacccggcctgccgaagcacaacctggcacaattcggggggatttctctcatgaatatccagacggtattttacgaaatgttatccatacctcagatagccgtgaaaatgcgcatcacgaaattgcaatttggttccccgaattagccgttaaagcacgaaaagcagacaacaaagtaaaagcctagcttcatttttaacatcacgattacgcaattcgcaattactgatcaatggtctgaacgccattgcgtccagtaattgcgaatttgtatacactggatgttttccgtcacaacgttagtaaagcttccaaagataacccgtaaactgccccaactaactgccaacacgcgccgaaattttcgcactaatcgttcgcactagttatgattaaaccaatcaactaaatggtttgggggaatcattatgaacatagtcgttggaccatatgtacggcggccgcgggctgtcaaatcggacccgcgcaacaccagtaaattttcgatgtttaattcgctacgacggattgatgaatgcctagtcttgattaaacgtactggcacaccaggattaattgattcaactgcaacgttaggtttgaacctaacccacttaatgggattgaatgtcatcgtaactagtcgtggacgttccttcaccatcattgttcaaggtcggcagcggtcattcacgctgactggctgtctcattgaagacacgctctacaacgccgttcacccagcacaaccagactatctgatttcactaaatcgccagctcattaccaatagtgatgacttaattgagcaactctatgaccactattagctggccagcatcacgcaccaaaggctaacccaccgtgtgggttagccttttaaattgccccatattaaatgatcagttgaacgactttaagcagtgtcgcggatggtttagccggaatcttcatcttttgagcggctggcattgctgtgtgaacattttgggcgaccggacccacttgcgagcgttgccccgaacgactatgcgcaaccaatacggtattatccgcattccgcgcgtatatcacactattagtagcatcttgtaaatcatcactataaatctgggtcatttggtgatgatagaccgcgctgtgcggatcgtctggctgaattcgctgtccggccgcaattttgcggatatgtaacggggttgcctcgttgatgacccgagtccccttcaggtgtagccaaacttgtgcggcttccaccttagctgccggaaaatcactaagttgtggctgacggattgccttaaacgttgctgcggtactacgctgcagccgacgttgatgataggtccggcgctggcttgtatgccgttcaagctgcacttgttcccacaccaaacaagcaccaaagaggacgataccgacccgtaatgcccaaatcaattttttcaatgattagccccccactttaccataattacgctacttaatttaacatggtcttagctaattatattggcaaagccggtaataatttaattattaatagggcagtcgcaccaactcgccatttctagttgcgcttccccttaaactattaacgatttctaacttgacagctaaactgatttattgtcaaaatcactatttaaatattttattttatgatggcaatacaaacattttgattatcgcgatatacttagacgagcattagctttttcaataaggaggcactactgatgaactcattcaagaacccacttatgacaacaccctatctgctagccataatcgccacactgacgatgctagttagtccactgacaacggttgttatatcagtactgatatggttgtcgggaattacgctggtgtggttacaccgccagcaacgatggctccgcttcttctacgcacccgtgtttttgtacacttttttactagaacaatggtatttctctccatcaacccagccactgacagaaacgattctcattaacctcgcaattcttggcattgccattttcagcacatgggcagcttatcaattacgtcataacgcgtaaattactcaccaagaaaaataagtcccccagatgcggtaaccgtttctggggggacttattgattgcttcaacagctaccgttaaataacgctcgttaggcaggcttcacttcggctagtttttgatccagatatttcttcaatgctgcttggggatgaaaaccaaccaccttttcagcgggctggccattcttgaatatcactaacgccggaatactcataatctcaaattgttgcgcaatttcctgatgttgatcaacgtcgagcgaagcaaatttcacttgcccatcgtacagttcatctaacgcttcaagcactggttcctgcatcttgcaagggccacaccaatccgcccaaaaatcaaccacagttaacgcggtaccatcagccaccgtcgcaaaagtcgtcttatcgactggttcgatcatatctaatcctcatttccaattgatttccgttctatcatagcatgttttcccacaaaattatgacttccgggtctgaatcacgtacataggtcacaaaatcttggtatatcggtgttctaccaatcaaaaattcgatataatagcgttatagaaacgatataacctaaaggaggaatttttgtgtccacacaaacaatcagtcccgaacaggactccgaattagtcgcttccgtcgccgctgaacaactcggtattaaagccgtgacgttgcgcaaatatagcaccatggttgaaaaacagcttaacgatgaaaatcgcttccgcccggccgataacagtcatcgcttatatacagccgctgatttaaaaacttttcaggcggccatcgaactcgctgaacagggcacaacgttagccactgcgctaggacgggcgtttggtgctaaggtcccgacatccaaacaaccggcggcaacgacgactcagtctgagaaatcagcgcctgcaactaccaccaagtcgcccctcatcacgacaaccaccgtcgatcccagcaaaatggcaccagcggccaagccagatggcccgactaatgctgagctctataagcagcaagaaatgatcatccggcgcttagattcactcagtgaccgcttaaaccaagtccttgaccaacttgatcaacaagccagtcaagcggccaaaccttggtggcatttctgggaaaagtagccgtatgctggtcaacatacttgctcattagacttacttcggtagggcaacagttagcattacctaccatccaaattaacgtgtgctgccagtcttaaaaataagctacctacacgttcatcgttccagttaactcgcccagcgatggctgctatcaagtggttctttgtcaggcaagacgcaaaaggcgcccagaattaaatttctgggcgccttttgcagctaattaccatggcggttagtaattagtttttttatcgaactactttgttgcagctaagtgcttttcgtacgcagctttgatttcattaactaaatcttcatctttcaagtcagttgtttcgcgaatgacttgttcgattggttcatccttcaataattgttgtaacttaacactttcactatcattaggatagttgaagaagaacatttcaccaactgtatcaactaaggcgctgtaatcgtgaccacgttccttcaattcccgaattgggcgaatgaaacgttcgttgaaacctaatttccgaattggtgtccggccgacccgttcaatatcatcagagatatatgggttttcaaaccgactcaaaatcttcttttgataagcatggtgtacttcaggatcaaagccccacttttgaatcaacaagtcgccggtttcacctaaaacgtgcttagcttggtcaacgacactgtcatccttgaccgcttcgccaatcgtcttgtagcctttcatgttaccagtataggctacggtggcatgaccagtattaacggagaagagtttccgttcaatgtatggttccaagtcgtcagcataatcaacaccctttaattgaatcttagggttcttcatctgggacttgtcgataacccattccttgaatggttcaactgaaacgaacaatggatcatcatgcttttgaagcggtacgatccggtcaacagcggcattggggaagcctgcattttggtcagcccaagcttgttcgtcttcatttaatgattcataaacggatttctttaatgactgactcccaccaatcatgttttcacaagcaatgatatcaattggtgtcgtattgttgttagcttgccgtaactttaacccgtcagcaattaatggcgcgatgaacttcaagatcttaggtccaatcgcagtcgtaaccatatcggcttgggcaatttcttcagcaaccgccttaggatccttaccgttgttaatacccttaacatcgtgaacttcaatatttttttgaccttctgcagccaattcaatggtataaccattccgtttgtttaattcgtcaatcaaagtatcgttaacatcaacgaaagtaatcttaaacccgttgtcagccaaggtttcgccaatgaagccccgaccaatattccctgcgccaaaatgtacgtctaacatgctaatcaacttcctttaatagatttatgatttcatcttcagattgagcgtccgctaacttagcaacgttggcaacgtcgctgcagtatatggcaatctgagacaagaggttcaagtgttcaccgttcaacccagcgatcccgaagataaccgttacagtcttatcatcatcgttatcatctggattaccccagctcacacccattggtacttggaccacggaaatcccggtctttttaatatacttcatgccatcttcagtaccatgggggatggcaatgaaattacccatatatacggagacatcctgattacgagcctgcattgcatcaatgtattctggttcgacacaaccaccatcgaccaatagttgaccggctaagcggatgccttcttcttgcgtagccacttgctggttcaacgcaatcattttcttatctaaagcttccattgttttcacctacgctatttcgttagttcgttcaaaaatgctttactaattaattgataaagttgctggcgatcgccagtcataaacgtctgcgtattggcctgactttcaatgactagtgcgcttaacttacccatcaaccgattttcaaaatcgctgatattggcgggcccgagcattaggacgattcgctgcaaccgaatcgattggttgtccatactcttaaatggtaatggctggtcaagttcgaaaatcgcacaatatggtgcagtgacttcctgacttaacgtatgcaccaacgccaagttcgtattgggaataccgaccggcgccagtcctaagcggtgtaacaaccggcccgcaacttctagcggatcatgaatcaagttcgaatcaatatgccgcgtgatcttaactagcatctcggccaccgtctcatcatcgttgcgaatcggcgtgatagtgaaacggtctaagatctgtttagcaatcgtcatctgttggtaaacggtgtcaaaatccaagttgattttcgtcggctcatcaaccggtgaatcgatcactttggtgcttggaaaatactgatgaatatattcccgtaaggcagtgacttcgttttctagtaacagtgggctgacaacgcggtaattcaacttaaatcccggtaacgttgtcgtggataaaatcatgtcaaagtcttgtaaattaacttggcctaaattaccaatccgcgcaacctcgatagccgtgatttcaggtactaaccgcatcagtcgcgttttcaaaattcgcgccgtcgtcatcccattcgggcacaggaccaaaaccttgagtgcttggtgactcaactgttgctcatacgtactagcaaagtgaatcaacaagtacgtcaactcatcagttgtaaaatcctggtctttaaaaatcgttgcgaagccgcgcaccaccgccgaatacagcttaggatactgttcacggacctcttgtaactcagtggttggcggcacgggaccattaacaccgttacgttgtagggcaatttgcatatgtgccgtcaagttattcaacaagcggtcatccgtcccaaacgaccagttaaagttagtcgcaaccgcgtcaataaactttttgacccgatacgttagttgcaaatcataattcgatagcgacgcgtcttgatcgattcgaaacgtcaagcccttaatttgctgggcgagaaaatcaatttcagctcccgtcaccaccgtcttaatctcagcgggtagttgggtcataattgccagagcaatccgttgatatttcaagaaatcatcccgattgatcccgcgcaaatatgtgacccgacgttcatgctgtaaccgcattactcccgtcgtcaacgtgatgatcaactgttgtagctgaccatccggcaccgaagaaaagtactttttcttcaaacttcgcactgcttgataacagataatcaacgtttgggcgtccagtaagttcaaaaaatacgattgctcatcacttgctgatattgctaagccttggttcaacttcccgattgttttaaaaaactcgtagtcgttgatttcattattcaaaatggtggcaaacagattgcgaatactaccctcagtccccgccacctgaatcccccgggacttcaaccgttcaattgataagtcgtagtcggcgaatggcgttgctaatgccgtcaaatcgtttgaaatcgttgcaacgctcacatcaaagtcaagcgcaagttcttttaattttacggaatggcccgtcatcagtaaccgacaagctagggcgttttgccgcgtttgtgagtcaaacgccggtgcaatcttccgctctgctgtcaattggctttgaaacttggccagggccgtctgcgatccacttagttgaaagtgatgcttctcattaacaattttcaaatcagcattggctaataccaattccaaattactgaactcgcgataaattgttcggcgactactgttgagaccggtttcaatctgactcattgaaaggccggcgggattcgctagtagcagctgtagcaactcatcttgacgttgtgtaaacttaaccatgatgccacctcatacgataatggtaataatatcattttatttcaattctgataccatcttatcatatttaggtgaactcaatagatcgtcagtaattaatacttggacctgcgtgtaacgggtctttaagtttttagctgcttctgcacttgaaacaactaataaactattattatcagccaattcgtcaattcctaagttcttaacactcacatgcttgttggctttcttgacccgatccttcatcaaggacgttgccattgtggctgttcctaaatgaccatcgtggtgaacaaagacaatttcatcaacaacactcaaatctaagttagctggtaggtcgtcgggtgcagccgccgttgcttgtggtgctgcggatgcaggtgcagcatcgctaacttgatcacgagcctttaagttaaccacaacttggtcatactttggactactcaagaagttgtcaacggctaaccgtaaggcgtgtggtgctttttgagccgcccgatcagctaattcgttttgcgtaatcactaataaaccaggttcgtctttcaaattgctaatcgccgtgttggtgacggacatgctaatgccagccttcttgactttatcccgtaataaggaagcccccattgcggatgatcccattccggcatcacaggcaaaaataatatggtcaacatctttgtatgaagcaatcacatcagctggttcagcgtcagtcgcactagcagcttcagcattgccactcttcatatcgctcattttaccttgagcagcggctaagtcatcatcaccggtcgacttgtcacgtttcaagacaattgcggcaacgataaatgatgctaaggttgctaacgttaccccgataattaaaccaatgtagttagaaatactctttggtgacattaatagtagtgaaataatggaaccaggtgaaggtgttgaacgtaaaccaacgtttagtaaactgaatgtggccgtcccagtaaccccaccagcgataacagctaggaacaatgctggcttcattaatacgtatgggaagtaaatttcatgaatcccaccaagaaaatgaataataatcgcactaggtgcagaagccttagcagtccctttaccaaacaaggcaaaggctaataagaccccaagacctggacctggatctggttcgagcaagaacagaattgacttacccgcactagatgcagcctgaattccaagcggtgttaaaataccttggttaatcgcattgtttaagaataaaatcttggctggttcgatgaagacgttggctaatggtaatagcttcatcttaatgatccagtcaacaccggcagccatagcagcactggcaccagcaaccaatggaccgattgcaaagtaacccaagattgctagtaacatcccgataatcccagcggagaagttgttaaccaacatttcaaacccgctcttaatcttatcggaaatggcgtcatcccacttcttaatgcaccaaccgcctaaaggccccataatcatggcaccgataaacattgggattgaagaaccgacgatgacccccatagtggcaatcgcaccaacgaccccaccacgatgaccggcaaacaaagtcccaccagtaaacgctatcaataatggcaataaataatggaccattggttgaatcatcttagctaatccagcattaggccaccaaccaccagccataaagatggcggtaattaagccccaagcaatgaaggcgccgatgttcggcataaccatattacttagtgcactcccaaatttttgaacgcgtgccttaacgcccagtttctttttcgcaacaggagcgctttgggttgcattcgtatttacattttcactcattaggtaaagctccttcctttttcttaacaacttaatcatatccatcggggtaagcggtttcaagaacttctagttagacccgtggcacaggaaactgtgccacaattaaactcactaattcacaaagttaaaatttggcacagtatcgataaaaacttttatatcggcaatgccagcagactaattaaacttttttcgtcagatatgatttaattttcacaatcaaattcaacattttatgcagaaaacacctggcaactctctcatcattttattatttaaatgattacgaatacgatttaacgttgaaatccccccgcaagctcctatacttataattaactaaggagtgacctatgtaatgaaaaaagacactgattgtaccgaaatattggttgggaaagctgctagcatggatggttcgaccatcgttgcccgcaacgaagatggctacggcccaattaatccgattaagtttattgtgcacgaagcccacgaccaaactaacgccagctacacttccgtaactaccggcgtcaccgttccgctgcctgaccatgcctaccgctacaccgcaaccccccaagccgatcaaagcgatgggcagtacgaggaagctgggatcaacgaattaaatgtcgggatgagcgcaactgaaaccactgccaccaatgcccgcgtactcggttatgatccgctcgtccatgatggcgtagatgaagaagccatggtcaccctcgttttaccctacattaaaagtgctaaggaaggtgtccaacgcttaggtgccctaattgaaaaatacggaactggtgaaagcaacagtatcgcctttaacgatcacgacgatatctggttgttcgaaaccgctggtggtcaccattggggggcagttcggatgcccgaagacacctacgcaattgttcccaaccaaaccgtggtgcaagagatggatctcaacgataccgacaatttcctaggtgccagtgatttagtggacttcgttgaaaagtatcacctcaacccaacacctggtcactttaatttccgtgaaatctttggtacccaaagtgaggcggatgcttattacaacactccgcgaacatggtatggtcaaaaactatttaatcccgaaatcgaacagaatcccactgatcaaaacatgccgctattccgacaaccaagcaaaaaattggctattgaagacgtccagttcttcttatcttcacactataacgggacgccttacgatccatttggcactttcgcttctggtaacgcccgtgaacaaacacgttaccggtctatcgcgatggatcgcaatcagtgctcatctattctgcaaatccggaatgacgtgcctgctaagcaagccgccattcaatggatcgcactaggtttcttcgcttacgccccatacgtgcccttctttaccaacatcaatgacacgccgattgattatcgcaatacaactagcacggtcagcgttgataacgtctactggttatcaaaaacgctttccgtcttgattgaaccacactggcatgaattttctgaaacggtcaatgcctatcgcgacgggtgccaatcatatgcccgtggccgggttgccgcaaccgacgcagccattaccggcaatccgaccgatttcttgaccaaagccaatagcgaaaccgccgccgaaatttccaaccggacccatgcgttgtttgatactttagttaagcaagggctgttgttatcgaaaacgacttgggaaaaaggacaaaatctatgaataagccaaaaatgattcaactgctaactatcctagtagtcgaatcattttttactttacatgagtacttattaaaaagccgtgcttcacaacgcaatcgttatgaagcacggctttcagttcatttttaacttaattaaaattaatacttcttgcttaacttgctagcagccgcttcgtcaatgataacggtaacgtctggatggttttgcaagatacttgctggtaattcaggggtgtctgggccttcaatcatacccttgaccgcatcagccttgttttcgccgaatgcttcgagcaataagtgcttgctcttcatgatggaagctaagcccattgagaaggcttgcttaggaacatcattttcgctggcgaagaaccgcgcgttagcttcaatcgttgattcagttaaatcaaccacgtgcgtcgtaatatcgcgaggagtacctggttcgttaaaaccaatgtgaccattacggccaatccctaagatttgtaagtcaattgggtgttcgtcaatcactttgtcgtaacgcttaacttcagcttctggatctgaagctaaaccgtttggcaagaatgattccttaaatggcttgtcattgaataaatgagtttgcatgaagtatttataactttggtcgttgtctggtgcaatcccaacgtattcatccaagttaacggatgtgcagtcactgaaatctaagtcactattaacgatttctttgtaagttgtaacgggtgtcgaaccagttgccaacccaaatactttcgcaccattgtctaaagcattcttaaatactttgaaaccttcttttccgccggcagcttgatcctttactacgataactttcataattaactgactccctctttgtttggtatagtccaattgtatattggtctagactaaaattcaagaggtttgtctgaaatatttcacttttattttttgcaatcgttatcattgttaaactgtcaagccaaactcctttaataaattaattgtatttttcgataattttgcctatacttaacatgttcgtaactccgtggaacgtgagaaattccacgactagccaaggctgcaaagtcattggctatttttttgcgctcatacctctacgccaaccatttatttgttcacatttcaatcaaactatccaatatttacattgcaattggtaacggctaaaattagctttgtatggaagatatatattacataaagggaggtgttaaccgcgaatcatgtcaagcaataccggttaatggccggcttctcacaaaaagaactcgccagcaagactggcatcacccgtcaaaccctgagtttgattgaaaagggcacctataacccatcactgaaactatgcctcaacctctgtcacgtactcaaccaaacactcgatactgtcttttgggtcgaacccagttaggagatccctgccatgaaaaagattcgtgacgaacgtttaattttacaaaatttcaagaacatccgtaccacgttgttaattgaaaatagtgctatcttactgattttattttggcaaggctggcaaaaaaacaatcttcagaaagcctttacgtacgacaatccgttgtatattgtcctgatgattgccgtttttaccatgatcattttgtctgttaatgtcagcaccccaatagaagacaaacccaaacggtcatggcgctaccttggcctgtgggcactcattgaactaatcggtttcaccgccctattctacttcctgattgcgataaatcagccgttcattagtctgatcgctggtatcgccctgaccaccgtcactagcggtatcatgctgtatagcaaccacctgcgcgatcgtgattaacatcagatatcacctagacggtaccattctaatcacatttgcggtaaactattcccagaaattcaatggacacgaggtttttgctatggaaccaacttttaacaaaatgactgcgaccggctaccatgccatcgaacaggaaattgaagacttaaagcaacaacggcccgagcgaatcagaattctggctgcggctgcggcactaggtgaccgttctgagaatgccgaatatagtagtgccaaacgggacttaggtcgcttagaaagccgcctgcgttatctcaacaagcagttgcaatacgcccaaatcgttcaaccagctgacaacaatcaactcgatatcggtaaattcgtgaccatcgaatttctggatgatcatgaccaaatcacctatcaattagttggaaaacaggaagccaatctcgaacaacaaaaaatctcattcacatctcccatcggtcaagcgctcgctaatcatactgttgacgatgtggtcactgtgaacgcaccgaacggggcttatcaagttaaggtaatcgcggttaagcgcgcgtaataaaatagttatgccaatcgatcggaagcttatctttatttttttgaatcaaaaatacactttctgaagcgtatacgtgctaaaataaaggcagtaaaaaagccggtacgttaataccgacttgaatcaaggcccgctctaagagcagttggctttaaatttagataatcaaagaacagtcacccaataccggccaaagttttggggtggctattttttgtttctggagttccatacctgatacatcgctagtgcgatgctcaaaatgatttgcaagaaagcaaaccgaacaggtagagtgaccacggctgaaaacctttcctagtgtgggaaacgtatttgtcatactaccacgacctttcaagatgaaaacagccaatcgctactgcaccatgtattgcgattacgctgatatcacaaaccaatcatcaacaagcagttgcccataaaaagatagcgacgagttatcatcacaacgtcgctatctttttatatcattcaaattaaaattcttggtacactgctggatcttgattattcaagcgaccatccacttggctcaaaccattaattgttgccatatcagctgcactgatttcaaaatcaaacacgtccatattacctgcttgacggctcggcgttgacgactttggaatcggcaaggtccctaactgtagttcccaccgtaaaatcaactgaccaacatttttatggtagtgcactgcaatctctttgagcgtctcattttgaagcatctcactggcccggccaaggggactccaatcttgcgtcaaaataccgtgtgcttgatcataatcccgttgtgcctgctggttaaagtacggatgtaattcgacctgattaatgacgggtaaaacacccgtttctttgtttaatcgttctaaatgttctggtaagaaatttgagaccccaatcgaacgaatcaagcctaacttctgggcatcaatcagtgcctgccaagcttcaacataatgatcttccttagggttaggccaatgaattagatataaatcataataatccaggccagctcgatataatgattcttgaatcgtattgatagcttccgtgtaggtgtggtggcgaccaggaagttttgatgaaatcaagagttccgaacgcggtactgacgaacgccgaaccgcttcaccaacagcaccttcattttcatagttaaaggccgtatctaataatcggtagccgcgatcaatcgctgagtcgatcacttgcacaccatgagcaccattcagtttatatgttccaaagccaattttaggtactgttaaaccatcacgtaacgtataagtttccaacttaagccacttctttcttttaaattaaacgatcattgttaaatttatcgttaatcttctgaacgatcagccaaggcatcacgaatcgctgcttcaaatgttgccggccgtgtcgttggggcatagcgttcgagcacacggccatcacgaccaatcaggaattttgtgaaattccacttgattcgaccatgtcccgccgcctgtttgaggtaagtaaataacggatcagcgtcatcaccattaaccatcacccgtttggtcatgggaaacgttaccccgtagtgccgttgacaatagtcatgggtctcatcgtcatccgccttttcttgatgaaattgattggatggcaatcccaagaccactaggccctcctgctgatacttctgataaagttcttctaatcctttaaactgtggcgccaggccacagttgctagccgtattcacgattagcaagacctgaccgcgatattgtgacaagtcaagtggcgcaccactcatctcagtttctgtaaaatcatacactgattctgccatcgagatccctcctaagaatattaaccaaatacattgctttatccatagtaaaccacaaaattgtgacttttcatcatactttgctttagtttccggaaaattgattgcactgaatgtcattatccgttacactaaacgtatcattcatagcaactggggtgccatcacggctgagataatacccattgaacctgaatctggacaatgccagcgcagggagcaatgcttttatttggggaaccatcaattcagacttagccgcctgccaccgataatcgtggtaggcgttttttgtcgcttggatgcgtgaatgacaaactacttttgggaggatttaacaatgaaatgggttaaatcatggtacttgaacgatattattttactggcactaattggtattttctttggtgccatctttatggggactaattttgtttataacattttaagtgcggccctgacaccatttggtctaagcggtctggctaatgaactactacttggcttatggtgcatgcccggcatgttagctggctacctcattcgactaaagggttcggcaacgctaggtgagctcctcgcagcaaccgtcgaaatgtttttcggtggtcaatggggaatcaccacattgatttctggtgtcgtgcaaggatttggggccgaactaggttatatcgtcactggctacaaacactatgactggttaggcttaacggctgcggccgcaacaactactgtggtcacctttggctgggaccttgcccgtaatggttactataaattacagctatggctcttgattttatacgtggtcgttcgctttatttcgatgtttgttttcgggggtctgttaactaaaaccatcacggacctacttgatcgcagtcatgttttaaaatcaacgcattaatacactttataaaatggaggctttctcgaatggctagtatcgcgctgaataatttaacttacacctatccacaggcgtcgacacccattctggatcgcgttaacctaacactaccacggcaaagcttcatcctattgacagggccatcgggaacaggtaagtcgacgctcctaaagctgattgcaggcttactacccctgactccagattacggcaccattacctttgatggtcagtcattaactgctagcaccgctaatcagcgcgctcagcacgttgccatgatgtttcagaatcctaatcagcagtttgccatggataccgttgaaaatgaactaattttcgcacttgagaacttacaagtgccccgtgaccaaataccggcccgcttacttagtgcgcttgactttgttggtatccgaaatttacagtcacgactattaaatcatttatccggtggcgagaaacagaaagtggcccttgcaatcattgtcgctatggatagcgatgtcatcctactagatgagccctttgccagtgtcgatccgaccgcacgagccgtcttgttagaccgactcgtggaactacgcaatcaacatgggaagacaatcatcttggcggatcatgacctaacaggttacgaacagctcgtcgatcaagtcgtccaaatcaaggaccagcacttacagctcattgatcgcaccacttggtctgagttatttgcagcctttactgagcagccacaacggtcatggtcagcaccgcaacgcgttgaacgcccttgttttcaacttgatcacgtcactttacaggcaggtgatcgtcaactattagtaccgacaacgcgtcaattgttagcacaacacaatacgctgatcacgggtcctaacggtagcggtaaatccacgttatttgaagccctcgtccgtctgcacccttatactggcgaaattcgttacgaagggacacctatcgacaagctaaaacgcaaacgctatgctcgccacgtcgccttgctttttcaggacgctgagacccagtttttaaacatcacggtcgctgaagaactggctcaaagtaaacgctatgcgtatggcgactactttaccgcagaccgtattcaaacggccttagtgcaactcaacttatccggtcgtgatgaacaagtcatctatactttgagtgagggacagaaaaagaaactacaaattctgctcatgttaatcatgcagtcaccagttctactcatggatgaacccttaaaagggctagatttgcattcgatcaatgccctggtcgcgttattacagaccacccaagcggcaactaagcagacgctgattattattagtcaccagttaaccggcctgatgccattgattgactatcagctacactttgaaaatcaccatttagattgggtggtgcgatcatgaatcctagcatgaaattattattactactcatcattgcgctagaaatttcattcacgacaattgtaagtttgaacgtggcactgattattctggcactgatttacctgctcggtcaccgaactcggcttcgaacattagggtggttgctactcattccgttgctaccagcaattggactttggagtacccagtacattaacggtagcggtgacaagactttgatggcctgggtcctgttcacacgaatctatgcgtttgtttttacgggcgctacttttacgctcacgactgacgtcttacaattaaccgattcgcttgagcaaaactggcatttacccgccaaattttcatatggcgtcctcgccgcgtataacttggtaccacggattcagcacgaagttcaagtgattcgggctgctggtctgatgcgtgggcaggtcctgtccttctggtcgccacagctctactttaaagcaattttggtctctatcaattggtcgcagaaccttgcccgggccatgcgctcccatggctttgtcgaagatgcaccccgcactcactatcgtcagattccactgactaagttggattggaccattgtgattagcggcgtcttgcttttacaagtcggcgccttcgtcattccgtggcgctagtggtctcattcactgaataaacactaaattaaaacgaggctgtgacataactagcctctgtataagcaaatgggacgagaaaccgaattttggtttctcgtcccatttgcttacgcctttgatttttaaagttggtccctaccgtgaccaatttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgaccagtttctggagctgaaagtaattctcgttgtttcgatttgaaatattcccaattttcgttcacggaaatccttttaagatatccttttggtgttagtgccgcggcaattagttgatgattttcatcatacttttcggcaatgtattctttaaagtcacgggtaaaaccatacttatcagtccgttgacgataagcattaaaattaaaccggacgttttgcggattgataaaataatcatctttttcatgatagtcccagttcataaccttacggtcatcactttgccattttcgactattctctttaagcattgtgccgtagggaatcaaaacggtatgctgaccgaattcatcttccaagtaccgataattactttcggaaccgtatccggcatcggcaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcaggttttaattgaccgttttgcatcggatcttccttgacccgcataaaggtggcatcgtgatccgtcttagagtagctgttacgctgaccatagatcgcttgctgtgcttggtgttcacgcattttatcacgtcgtttattcaacttacgtttttgtgatttaacagtccggcgttgctgtttggctgggttcggggaaacctgcttagttgcttccacggtttcattaaggaccactaagtgatcctcaaccttgctaatcatgatatccaatagttcgggagtcagctctgatcctgccggaatttcaccgacaattttagcttcatgaagctcgcctaacagatcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagctatcggttgtcaaagtggccagttcatcagaaattctaaagcgacaaatcgtccggtaggacggaatttggtcggcaattaaccacccagctggcttgttttcacgggcaaactgttcaattttacgactgctgaaaatgccatagcagtatgctaaaaggaccagttttaacatggcaccgaggttatattcccgcggacggccaaactggtaatcatattttagttttaaactctcaacaagctggttgatgtaacgagcaggatgatgctcttctggttggtaatccaaggcgatactcaaagtggtttgattcatgttataataatcttgcatattaggaatgtcctttcgaggataatttcgtagagtatcgggtgcgaccgatgctctttttttattttctattatatcaaaaacaggtctggaaaaatccgaagatttttccagacctgttttgtttctagagacttatgtcacagcctcgtttttgggtaatattccccacttaggtcgggacacaacaataacaagttgaccttaattcatgctttcagccgatcaatttgttgccgtaacgcctgaatagcagctgtagaagacgtcgggtctgccattaattgatcatacttgaactgaagtactgctaagtcagcttctaccggttgcggcgctttaacaactttgtcaggatcaactaattggtgcgtctcgaattgcaacacccgagtagcaacggcctggcgaaacggttcatcatgtgaaacaaaaattacggttccaggataattttgtaagtaatcggccaacgcatccagcgcgtccacatccaaataattggttggttcatctaacattaaaacgttatattgaccgactaaaatacaaattagctgtaatttaactagttcaccaccacttaacgccgatactagttgcggataaaatcgtgctggcaggcccaacgcgcccatgacgttacggatcgtttgatccggtaactgactgacttgccgcaccgtttgccacactgactgtttaccgtcgagcactgtcatatcttggttgaatactccgactcgtgccgccggagccaatcgtaatcctgacacccggccacctaaaattgcacgcagtaatgtggtcttaccgctaccgttgggccccacgatagcgacccgatcatgtggcctgatttgaaagtcagcgtgtgctaacaacgtttttccatattcagccaatgtgacattaagaccagttaccacggtcttacctgtaaacgtcggaaaatctgtcgcgactaacttaaagcctgaagtcgtaaagggcttagcaacttgcggttcccgttgtcctcgggcgaccatgcgtttagccgttcgttccatcttggccgcagtagcttccctagtcgctttcgtcttggcacgctctacttgcgacattcgccgattgccttttcgaatccgctgggctttttcattacgttgacgctgcgctgctagtaactcacgctgatgagtgttttggcgctgatacgcggcttcctgagttgcgagttgctgcgcttttaccgtctgataatatgcgtaattgcctgcatatgcggtgaatttttggtgttcaactgcccaagtctgtgtcgtcacagcatttaataattgccgatcatgtgaaatcaacaacagcaacccacgaaaacgttgtaactgattaataagccattgctgatgtgttttatccaaattagatgacggttcatctagaattaaaattgttggccgggcgctcaaagcctgccgaattctggttagcatagcttgaccaccactttggtcaaaagtcggtgcgatttgggcaacatagctgactggctcgtccaccataatttgtcccgtataatcacgatcagtacccgtcagtaaatgggccagtgttgatttaccagcaccgttccgcccaaccacgccgattttatccccggcattggcgactaatcggtcaattgtaaatagtggccgtcccgccatatctttttgaatattttttaaattaatcattgtcattaataagcatccccttagttgcagggactaatttatggcacaaaaaaacgtcctcaaaatgagaacgctggcaattgattccaccagcaccctaattaatcccaaaacggacagtccacccctatcgctaggcatggctctgttcagttactagaattaattagttgcgcattggctgaatacctcgtgttttataagttactttgtagattagcatgtttaatttcaatttgcaagaaccattgttttttaaaagttttttcagtaaactaaaattactttcagaaagcaggtgtcagcttgaaaaagatcattgcaattaccggcttcgcaatgctaggtggtggtctccgggaggggcttagtttgctcgtcacttggccacagcatttctggataacgtgtctgattaatattgtgggagcatttgttcttagcctgattactaacttgttaccagcgcggttacccgtctctgaagatattgttatcggtatgagtgtcgggttcgttggtagctttactactttttccaccttcacttttgaaacgctacaatcgtttcaaagtggtcatagcgttttagctttaagttatgtcgctgctagtttagggttgggtttgctagcggggctagctggaaacttccttagcacctattggctaccaaaggaggaattttaatgttagtcctagtcggattggccggtgccggcgcagctgtaggggccttaagtcgttacggcatcatgcgcttagcactacctctcaatcgatggccgttaccaattgccacgttatttatcaatctaaccggcgctttattgctcggttggattttaaccagctcattaccgcccaactggcagatttttctaggaactgggattatgggtggctatacgactttttcaacaatgatcaacgaactcgtgttgctcggccgtaaccaccatcaacgggtcgcctgggaatactttggcttgagtctcgtcggtggcctagtcatggtttatctcggaactttaatctaactcaaaaaacaggaagtctcacaaaactaactgagatttcctgtttttgttcaatgactatttagttccaacaagccgcctttacggctagcgtgccgatgacactagttttaacaacgctcatctttatctttcaaattacgtggtggcatttccgaataatgcaacgccggcaatcgccacgacgatcaggcctaaccataatgcgattttaaataaaaacaacccaatcacaatcatgaacacccaaccgataattttaaaaccaattttaaagataactttgagcaaccataaaccaattactaaagcaatcaataaaccgatcatctatgcgctctgcgaagagagcttccctccttacaagtcccatcatgggtaccttgccagttagtatagcacgcgctatacagcggcagactgattgcagtcgtaaattaagagaagcttaattttgcaacgccgcaacttgtcgcaccatcgctaattcttcgttagttgggatcaacatcactttaatcttggaatctgcgccactgatgagtccttcttgacccgcttcatttaatttcggatccagggtcacaccaaagatgctcagttcatcaataatttgctggcgcaaggtcgcattatgctcgccaatgccgcccgcaaaaatcagcgcatccgcccgttttaattctgtcaaatagctaccggcatacttaacaatccgattgacaaaaatttcaacagctagttgggcttggggattcgtggcttcttgcgcacggatttcacgcatatctggtgaaattcctgagattcctaacaacccagactgattgttaagcatcatcatgatttcattcggatcatcgatctttaaagctttcatgaggaatggcaatacggccggatcaacgtcacccgcgcgcgttcccattgtgacacccgttaatggcgtaaagcccatcgatgtgtcgaaggcccggccattttttacggcagctaatgacgcgccactacctaagtgtaacgtcaccaggttgaggtcatctttcggcttagccagcagttctgcagcccgaccggttaagtaaccatgcgagataccatgttcaccgtaacggcgaatatggtatttttgggtcaattcatatggcaaactgtaaattgcattcatttctggtaaatcggtaaagaattgactatcaaataccgcgtactgtttaacggtcggtaaagcctgagccatcgtctcaataccacgtgcctccatcggattatgcaatggtgcaaagtcactaagccccttaatggcctcgagtaccgctggcgtcacttcaactgcttgcttgaacgtttcgccacccgcaacgactcggtgagcaactgccgtaatttccgttaatgagtcaataattgctaatcgctgtaattcagccaataacatctccgccgcatgattttgatctaaattatcgactgtcgtttcaaacttttgatggtcaccatacttgatggtgaaaattgaaccgggcatactaatccgttcaacgagaccactagcaaccaccgtttcagcaggcatagcaaataattgccatttcaatgatgaactacctgcgttaataattaatgttttttgcatttctcaatcaactcccatgtaatagaataccgaacttttctgaaaattgctcaacttttttcaatcgtgtcatttgacatcttaattcattcgctagtcccaatcttccactgttaactaaccagaacatgttattattaagacgttaacttttacagattagaggaacccaattaatgacgaccacaaccgatgtcgacctagtccaaactggattagcgcacttaattcaccacacgcgtaaacaaatcgaatcattaactaaagcattagaccacctgcctggtgtcagtgatttgcaactcaagggcacgttattgaagacgtatgctagccagatcgaggggcaccatcatttcgtcgaattgcccgactatcaaggccaccaactcagtattaaactcgatattaaaaaatcaattattgaaaatgccgaggattattttcatcgttatcacaaaagcaaacgcggtcaagcgaccgttcaacaaaatttggcgacggccaagaccgaactataccagcaattagcaactcaagcagctttcgaccctaatgatccacaagcggtcgccgcgcttaagcaaacactgattgctgcgggcgcgattcatacccacgttttacactcatctaaggccccaacacccgcccatccccgccgcttttacacgcacgaccacgtgctggttgaagttggtaaaaatagtcgtcaaaacgaccacctaacattgacggcccgtaaagattactactggatgcacgcgggtggtgaaattcccggttcacacgtggttattcacagtaatcatccgagtgaacaaaccttgcaggaagcggccgtactgacggcctattacagtaagggtcgtcagatgaaccgcgtacctgttgatgtgctcaccgttggccagatgcgtaaacccaagggtgctaaggctgggcttgtcacctttagtggtcctgcacgcacgatcaccgttgtccctgatgctactttagctgctgaattacgtgaccaggaagatattcaccatgacgccgattgagacctatattgctaacacaccacaagcctatcaatcgcaattaatagccttacagcaaaccattgcaacggtcttaccagaggcgcaagagcagttaaagtaccagatgccgaccttctattggcacgaaaacgtcatccattttgctttattcaaacatcactttggcttgtacccaacgccaagtgcaattgagacttttcatgatcaattaatcacctataaaacaagcaaaggggccatccagtttccgctggatcagcccctaccacttgaattgattactgctattaccgaattccgtcgtcacgaaatcatagcgaaatacgacctttaggattaccgctgccaccaagactgtttaagaaaatcaatggcggttacgtcactcaacgcaatcggcttaacgactcccgcctgttgattcaaaaaaagctgctggtcgtccacagccgcaattaagccactcggctgatgaccatcacttaaagttaaccgaaccacgcagtttaactcataagcttgcaataacgacgcttcaattggtttcagctgttccattagatcacctcatcgaaatagtagctccatcatagcacatttttagaacgtacgttcgataaaaactattacattttgatgacgttgataaaccggtcacttgtaccaatcagtaatttcaccagctaactaattatgccgttaactaccgaggttaccgaacattcgcccaaattattttaaaattgcccggattcggtcagttgaagttagcgcacggctatggctcagttcaaaacatgaccgtcattaaattcaaaaaccgccagcttagaataagtctcgtatttgagactgggcgggttcgggctcaaatcgatgtcggtttacgttccagcaattgtcgctccgccccggaggtcggaaatagggcgattattgctgaagaacaggagtctacctaacgagcctaagagtgagctatttttgaccttaataaacaggacgcgctaataaaaaggccactccccggcatattgggggagtggcctttaatgcaatttactttagaatcgcggtaatagcttttacttcatcatcactaaaggttaaattgtgcgttgcttcaagattagcgtgcaagtggtcgacattggtcgtaccaatgatgacgctcgtgacgacctgtgaccgtagtagccaagccaaagccatttgggccaaggtttgtccccgttgctcagcgattctgttcagggcattcaactgattgacaacggctgcagtcccctgatcaaataaatatttattcgttcgatgaatcggaaaatcggctggaattccttgtaagtagcgctgcgtcaataatccttcagctaatggaccatatgccaccaagcccgcattatgctggccgagatagtcaatcaggcccgctgtttgagcctgttgattcaacatgttatatgagtactgattaaccgtaaacggcgtgtgcatctcattgaaatacttaatcatcgttgccgtttggtcgcggtcataatttgaaattccgacatacaacgccttcccctgacgaaccaactggtcaaggggctgcggcagtttcatacaaatcgatgttagggtctggacgatgtgagtagaaaatgtcgacgtaatctaaatgcatttgcttaagactacgatccaatgaactgatcaacgttttgcgtgagccgaaagccccatacggccctgaccaggccggatatccggctttagtcgtgatgacgagctcatcacgatacggctttaaatctcgttgcataatttgtccgaacgtccgctctgccgatcccttcgatggtccataattatttgctaaatcaaagctaaagacgccatgatcaaaggcatctagaaccacttttcgtgaattgacaaacggcgcttcatccccaaaatttcgccataaccctaacgagacaacgggtaattgtagccccgtcttacccacgcgtcgaatcggtaattcgtcatagcgcgttgatgctgctgaatatgtcatcattactcacctcatctaatttttgaatactatttatattataccgcgcctgtaatattggtactgatcaaacgcttaagcggatacaaaaaggcgatcctcgccaaatgctaggaccacctcacttaggagtttatatgtgatgtctgctgttgctgcctaattagactttgatttgaaataaggttcaacagtgcgtggctatttcaaaccaccatctattgtagcccggaatcgcccgttcgttaagtcattgcgcgtcagaattgaggtaggcggttataatatgctaaatattggcgaccatggacagcatccaccattactttagtgacgctcgtattagctggttccggtaagctcatcggatcggtcggctttagtatcgctaaggccatggctttgacggtaaaaccatgggtcacgacaatgatctgctcgtctggatgggcttgtgctgttgtcttcaaaaatgccgctacccgttgttgcacgtgctcaaaagtctcgccatccgtcgcaacctccacgtagcttggcaaaacgtcctgtaaaagtggatcaaagtactgcggataggccgctagcaactgatcattatcctgtccatcccactggccgtatgaaatttccaataaccgctcgtcctggctaacaggtagttgccgaccttgattcaaaatcgccgccgtggcctgggttcggtcaagcgggctacaaatcaaccggtccgcgaagctaatatcaaacgtatcgtgcaacgtttgcgcttgctgcttgccaaccgaattcaaatgcgtgacggctgtattaatcgtgccttgttttaaattttgggcgttggccactgtttgtccatgtcgtaccacgtaaaaggttgtcatcgtgtgcctccaagattaaattattattaataatactaattgtgccacagtcttttctcattatctagcttgacaaatagttacgtgcttgctaaattaataccaacgcaattaactgactggtgccaacaccagtttaacgaaggagtgtccaactgatggttctaactaatcctatcaatcatcatatcagttcctcctggtctacacacccatctgtgtcggcctaattttgcgtacgcaaatcagcctgagcacggatgctaagacattcgctaccaggtggaattgcttaatctcgttattatccgtcctggtagtcgaaaccgactgcgaggacttttttattaccttgattaaactactgaaagcgaggatttttcatgccaatttataatttttctgctgggccagccgttctaccacaaccagtcatcactcaaattcaagcggagctaccatcatttcgagactccggcatgagcattttagagatctcgcatcgctccgatttatttgcgcaagtccttcaagatgccgaacaagatcttcgcgatttaatggccattcctgacaactatcacgtgctcttctttcaaggcgggggcacgctacagttcacagctgcgccactaaatctggcgcctcatcatcgtatcgggttgcttgacagcggtcactgggcacaacgcgccgccgatgaagctaaacgggtcggtactaaagtcacgatactggggagtagcgctgccaaccattttaaccaactgccaacggtcgtccagcccatcgatcaatccctcgattatattcatcttacaactaataatactattgaaggaaccatgatgacgcgcctgccagttacgggtcaagtaccactggtagccgacatgtcatcaaactttttaggtgaaccttaccaagtcagcgattttgggctcatctttgctggtgctcagaagaatctgggtcccgctggtttgacaatcgtcattgtccgtgatgatttaattggtcaagtcgccaacctgccaagcatgctggattaccagctattcgcggctaaagattcgatgttcaacacgccgcctgtttttgctatttacgccgcgggtctcgtactcaagtggctaaaggcccaaggcgggctcagcacaatgactgctcgcaatcacgctaaagccgccttactctatgatttcttagaccagtcacaattatttactaatccagtcaagaccagcgaccgttcgaccatgaacgttccattcgtcacaggtcaggccgacctcgatgccgcagtcattcaaggcgcccgtgagcacgggttattaaacctaaagggtcaccgcttagttggcggtatgcgtgccagcctctataacgccatgccgttagccggtgttcaggcattagttgactatctagccgcttttgaagcacaccatcgttaatcaaggaggatatttatgtatcaagttaaaacctataacgccatcgccccagccggcctcaacacgtttactgctgattacacgctcaatcaatctgagcatccggatgcttacttaattcgctcggtcaacctacataccgagacattaccgtcatcgttgaaagttattgtgcgcgctggtgccggcgttaacaacattcctatcgatcaggcaaccgccaacgggactgcagttttcaacaccccgggaagtaacgctaatgccgttaaggaactcatcatcggcctgctcattatggcatcccgtaatctaatagctgcaacgacctattcggcccagcatacagaagctgatatttctcaacgcacagaacacgacaagacgcaatttaatggtattgaattaacgggtaagaccttggccgtcatcggactcggccatgttggcgctctcgttgccaatgcagcattgagtctaggcatgaatgtaattggttacgacccctatctatctgcagatgccgcttggaacattgccaaacaagtccagcgagcggccacgctgccagatgcagtcaaacaagctgattttgtcaccgtccacgttcctaaaaatgccgacacacttcatctgattaataaagatgcgttagccgccatgccaacaggcgttcaattatttaattattcacggctgggcatcgttgacaatactgccgtcatgaatgcgttagccacgggacaagttgcccactactacaccgattttggcgaaccccagcttgccaaccaatccgcggttaccgtgacaccccatatcggcggctcgactatcgaggctgaaatcaacggtgccacacaagctgcgcgcactatcatgacttatttggaaaccggtaacgttcatgcggccatcaatctgccagacttaaacgtcccgttcaacgcggcttaccgctttacagtcattcacgaaaatgtgcctaacatggtgagtcaaatcacggccaaactagcagcggccaacctcaacatcactaccatggctaacgccgctaagcaccagattgcttacaccatcattgacgtcgacgacctacagcagccacaacaagccgacctaatagctgaactgtctaaaattccggcagtgagtcgcgttcgactattaaaacggggtagcgtcgaatgaagattgaacacttacaacacccgacaactcaccaactcgatcagttaatgacaatctggttaagtggtaatttaacggcccatgactttgtcagtgccgactactggcgtcaacaagcccccttagtacgtgaagcattacaatcagccgaactcatcgtcggactgaccgacggacctgaagcttatattctgggctttataggcttacaaaacgattacattgccggaattttcatttgcaatgatgctcaacatcaaggtctggggacggcgctattggcgactgcccaagctgaccatcatcaattacaattaaacgtctatgttgctaatcgcccagccattgccttttatcactatcacggtttccgtgtcattgatcaggctagtgaccaagcaacccagcaaccagaatatacgatgcaatggcaacgttagttttcttaattaagccagtacgattcttaacgagtcgtgctggctttatttgcttaataatattaatgattaaaaaaataatattgtatttaatctaattttaatgtattctcatctacatatcataatcatttgaagcagggggtacatatatgcaatggaaattatttgccacagttgccacgttaacggcaacgaccggcgttttactcgtcggctgtggtcagtcctcatcaagttcaagcaatgccggcaacacaacggccaaaatggccaagactcaagtcctcaattggtcggaaaacggccaggatttgaccacccttgacccgtccttagccactgatgttatcagtgggacgatgatcagtaattcgcaagaaggtttgtatcgattaggtaaaaacagtaaggtcacaccaggtattgccactaaaacgaccgtgtccaaagataaaaagacttatacttttaccctgcgtaagaatgccaaatggagtaatggcgatcaagtaaccgcacaagactttgtgtatggctggcgtcgtacagttaatccgaagacggcttcccaatacgcctacttatattccggtatcaaaaatgctgacaaaatcgtcagcggcaaggccaagactagtaccttgggcatcaaggccgatggtaagtataagctgaccgtcaaacttgaaaagcccatgcagtatttcaaattattgatgggtttcgtggtcttcttcccgcaaaaccagcacgcggtggaaaaatacggaaaggactacgggaccagttccagcaagatggtttacaacgggccattcaagatgactggttggaaagggaccaactcgacctggacacttaagcgcaatcctaattactgggataaaaaacacgtttacttaactaagatcaaagaccaagtcgtgaagtcgacgacgacagcctttaacctcttccagagtaataagctcgacatggcaacgttatctggacaacaagtcaagaacgaaaagaataataacaaactggtcatccgtaagtcttcacgtctaaattacttggaattcaatcaaaagaaggtgaagttactcgccaataagaagattcgtcaagcaatgtcactgactttgaatcgtaagcagttggtcaacgatgtcctcggcgatggttccgtcactccaaagggctttgttacgaccggacttgctactgatccaacgactggtaaggactttgccaccgaaaatacggttaaatcagctgttactcaggacaccaccaaagctaaaaagctctggaaacaaggactaaaagaaaccggcaagaagtcggttaccttaacgttaactcatgacgatacagatcagatgaaggccctcgctgaatacgttcagggacaattggaaaaggagttaccgggacttaaagtgcagagtgtcaccgttccttataagacgagaatttcccgagaaattgcgggtaatttccagctggtcatctccgcatggcaagccgactttgctgatccagtttcagacctcggtatcatgacatcaactaacgattacaactttggtaagtggaccaacaagactttcgatagtgctatcaacacagcaaatagtacaaccagtacaacgaagcgttggcaagcactcgcaaccgctgaaaagacgatggcgacggatcaaggggtcgcaccgctctcacaaaacgtcatcgcacaaatggtcaaccctaagctgaaaggcctagtctacaacacggcgggcattaactataacttcaagagtgcctatatggacaaataaggtgacctaactagcatcgcctcacgtcaaactatccttaaatcgcacaataaaaggtatcgtagcaacaaactacggtactttttttgtgttccttgacacattttgcggctgttaattactttaattattagaatcaaaacattgattttaatcttgctttaatgtattctcgtgaccattcaagttggggggaagttttactatgaaatggaaagtaatgttgacaactgctactgcggccgcatcgaccggccttttgttagctgcctgtagtcaaggtcagtccaagtcagataatgcggggaacttacgcgcgggaatggcacaaaagcaagtcttgaactggtcagaaaatggctccgaactaacgactttggatacttcgctagtcaccgattcgatcagtgccaatatgatcaataacacgatggagggcctctaccgtattggcaataataataaaatcacaccgggcattgcgacccatactgtcatttccaaagataaaaaaacttatacgttcacattgcgcaaagacgccaagtggagcaacggcgatcccgtaaccgctcaagatttcgtttatagttggcggcgaaccatcgatcccaagaccgcttcgcaatatgcttatctttattctggtatcaagaatgccgaccaaatcaccaatggtaaagctaaagccaatagtttaggaattaaagctgacggtaaatacaagctaaccgtgacacttgataaacccatggcttattttaaactcctaatgggctttgccatcttcttcccgcagaaccaacacgccgtacagaaatacggcaaggactatgggacaacggccaccaagatggtctacgatgggccgtttaccatgaagggctggaaaggcactaatacgacatggtccctgaaccgcaatcctaaatattgggataaaaaacacgtttacttagaaaagatcaatgaccaagtcgttaagtcaaccacgaccggattcaacttattccagagcaacaaactcgacatggccaccctgagcggcgaacaagtcaaaaacgaaaagaataatcccaagttagtgctccgtaagacatcccgtctgaactacctcgagtttaatcagaaaaaggtgcccgcgctagctaatgccaagctccggcaagcgatgtccttaactattgaccggcaccaacttgtcacggacgtactagcggatggctcagcagttccaaagggctttgtcaccaccgggctcgcaaccgatccaacgactggtgaagatttcgctactgaaaatgcagttagtgcggcgacaactcaagacaccgctaaggccaagaaactgtgggcagaaggattaaaagaaaccggcaaaaagtcattaaccttaacgcttacgcacgataatattgaccaaaccaaagagacggccgaatatgttcagggacagctagaaaaggaactacccggtttgaagattaccgatattaccttgccattcaaaaaccgacttgcacgtgaaacatcgggtgatttccaactcgctatttctggctggcaagctgacttcgccgaccccatctctgacctaggcattctcacttccacgaatgattacaactttggtaagtggaaaaatgctgattatgacgctgctgtcaagcaggccgagcaagcaactgatccgacagtacgctggactgctctaggcaaagctgaaaaaattattgggacggatgaaggcgttgcaccattaactcaaacaacgctggcacagatggtcaaccctaagttaaagggcctgatttataacacttctggtaccaactataacttcaaagacgcctatatggcaaaataaaccatcagataactcacagacgctcactagcaaagactagcgagcgttttttatatagtcaagatatatttttagaatatgcaagattatgtttaaatattgacaaaattatataaaaagtttttaattagggtaaatgaaagctgtttcaattatgacttaaatatgtaaaggaagcgttgatggtatgaacattgagcttttcatcgcccgccgcaaagccctaggactttcacaaaaggccctagcagatggtatttgtactcaggcgacactaagtaagttcgagaacaatggcaaagcacctgccatacgaatcgttgcccaactttgtcagcgactcaacctacaattggaagatgtctttccaaccgaacgcgtcgctgatgccgctgttttgaagattttggaacaggtcgagttcgacctcattacaactgaatatcaagatgccgaagtacaacttgaaaaggctgcggatatgccgcgacatgaccgcgaaaccaaattacaatattgttatctaaaaggctatgttgctgcccttaaccaccacccgatcagtgatgtcatctttaattttgaccaaatcatcaccgatttggacgaggctcacatcacaatctatacacagctggcctactgtggtatcgggattgcttatcagcagaaccaggataacgataaagcccagtactattttgaaaaagtacgccacgccctaccgaacctaccgctagaaacgaccgctagtgtttggcgcgtgattaacttagcttattatacgggggctttttacgctaacattaatgatacaccgcggagtttgcagttattaaactacgggattgagatttgtgcgcgattccacgttacctattacgcagcgcggatcaaattcttacaggctcaattatccgatgaaccggatcaaattcatgaatatttaaatgatgcggccgcccttgccagaatgaacaataaccggcaattacttaagaatatttcaagttattcagattctcactaatttacggttaaataattgatttttgttaataagtcgcctaaactgcaagtattaaaagacgagtttttacaactattgaggaggtcttgcccatgttattagcaggtttattggccgcagccggactagctgccgttgccggcgtcgtggctggcgcccgtgttcccgctgcccaaccagtcagaattaagcatgaccaacgcacatctcaaaatcgtcgataatgtggcgacacttatctatgatataaataaaggctactggaagcgaaattccagtagcctttttgtttaattaaatcgccgttgacgactaacaactgttagccctagcaagaaccagcccaaaatcattagccaatccattgattgttcactagtctgtggcaattgttgcgccgacttgcgattagttgcttttgtaactttaacaactggtttagaagttgctactaattttattggctgtcctaacaatttcgttggctgagtcgtggttactaaattagtttgcttgactaacttagctgtctcagtcttcgttgtgacaacctgatctgaatcactatcctcgtcagcgtgtcctggtagcaccggttcacttggttcactcggttcgcttggttcgctcggttcgctcggttcgcttggttcgctcggttcacttggttcgcttggttcgcttggttcagttggttcacttggttcactcggttcactcggttcactcggttcgcttggttcactcggttcacttggttcgctcggctcacttggttcacttggttcactcggttcgcttggttcgctcggttcacttggttcgacctcatcggcaaaaactaattggccttgataagcgctttgctcattcaacacaagcacttgcgcctgtgtattgatcaagtaaccgtccggtgcttgaatttcgctaaccgtataagcgccttgcgttagacctgtaagctgtgcttgaccagtcgcatcagttgtcaactgagcaaccagcgttccggcagcatttttcacggcaaaaaccgccccggccaagcgattggcgccactcgagtccgtcttaatcaccgtcaatttcccggtttgatacgtattcgttaatgtcaccgtctcaccactagttgtttgactactgatatagccagcaatggccgtttcaatcaccgtataagtgtacgcattgccataaacatccgtcacatccaaatcactgaaagtgcccgtatagccatttgctgacgttaattgcaaggtctgataagcttgaccattgcgttgcaacgtcacttcaacggtcggcgtttgcactccagctggcacgtcagcccaaactttgttaacagtcagcgccgtcttagcaattcgtttgtcaaccacactacctgtgaccacgttagccgttgcttgcgctgcggataccgtgaagacgtgcttggccgtgtcgatttggtagccactcggagccgccgtctcaaccagcatgtacgtcccagccgacaagttaccgatgcgtaactgtccaactgaatcagtcaccaaatcggtccgaagtaccgtacccgtactatcctctaactgataagtggcaccagcaactgactggccgtcaccatcagttttattaatgaccaaactgtaactctgaatgtcatcactagcggttccggaaccaccaaatctaacggccacgttcgattgttcactctttggttcgcctgtcgaactgccctcatttggatcagtcgcatctccaatgacaggtgcatacgttacacccgcattattggtgtacgtatgtcctactgtcagaccaacttcataaaatatattgaccgctacatctaattggtcaatattaattgtcatctgctgacccacaaccgtcacggttacttgtggtgttgataccccatcagcgtaggtaaactgctgcgttgcaaaatcataagtgcccagtgccgcgtctttaacaaaggcaccgtcagtataatgaccagtttccaacgtcatggtaccttcgtgcgtttgataaaggcccagctgatcaacaatcgcaacttgctgccacttttcactattaatgtttgcgacaacttgccagatcattttggtgggattaccatcagcatctaaactattactatcggcccagccaaccttattaatcccagtcgtactactgccagtggttgcgctagtcccagtaacataaaacgttaagtctccttgacgattataacgatcactagtcgcataataatcattaaaagttagtgttccggtttgactaccggtctcggccgtaaaagtcccgacgaccgttccatctgatttttggacatcaatatgctgcgtaccattggtaaagacaacattctcgggtaaggtcaccgttgctgtactgccagcagttacgctaacatcatcggctattgaccaatgatacttcgcgatatagttcgcatacagactcaatacatccgtagcgctatacgtaacaccatcatcgtcagtcaccgttgcgtcagtagcatcgagcccctgaaccgcaaccgttgcccgttgtgctaaactgcgaagactggcccggctcattctggacagtgtcgcgacagacgcagttgcttgatccgtcgtagttgccgttctcgccgagtctttttgactggtaacgacaccactgtacatattagtcgtttgttgctgattctgggtcgttgcttgctcgttgttcgccttcgcactagccgctcgttgatccgctttggcattagccgtcgcccgggacgtcgctgtcgtatcagtactgtccgttgttgcttgagcggctgtcacacctgaagtcgtttggctagtagccgttgtgctagatgattgggttgatgactcagacgtggtgaccgctttgctagtcgccgtttcagtcgccgcaccagttgccgatgctttcgtgctactgctactgctactgctactgctactgctactgctactgctactgctactgctactgctactgctactgctactgctcgtagtttgtcgcaacaccacttgattagcaagtgtactcgagccagaagtctgcgtcgtttcagtggcagtggtagctgtgtccgccgcactcactgtttgatttgtcacaatcaatgtcaacatggcggccgttcccattatccaagttttgaaatcgattaatcgcatgatatcccccctttcttatataagttaaaacttttaaaccgattacacgccttaattataaaccacattccgcaaatttgaagacactttttgtcaaaattcgtcgctcacagatagcagttacataccagcaatatttgttcaaaaggctcattacacctatataatttttatttatgtacacttaattaatttaccgatatatcaacattttaaagacatgaatcataattagtattataatattttatacaaaagttgtatgccatcaattttgacgagttcgtgacagttgttagctaattaaaataatttatgctgattaatatagatttaactaattgcaatcagtaaaaatgatgtcattcgtttcatttataatttaaacccattaactgctttagttgcttgtcaactaattacgtcgagaaacggggcagactggcgctaccgatgacatgtagaccaattattgatttatcgagcgatatataacagcaccttaactgataagtattttttatagctttattactaatagtttgtcattaacttgtatgctttttaatctgcataatgtttacttatcgctttaacactttaacctttatttctaacgactcccacttaagcaatgcaactttttttccggtgattaatcagaccaaccgacacgtcatgataatcaaaacgatgtggcagccctttaactgataaaattatataatgactcaaaacttaatttaccagcaacactacatctgtaccaatcagcactaacattcttattaataatcattatagtttaagcgcgttaactattttgtaaattaattttcactaattatcctgacactattcgttataacaatggtatgattaacatgacgtataataaccagctttaatcaatcagtcggagcctgcttacctgcgactattaattgcgcaaccaacattaatattttatggaggctacatttttcatgaacattaaagacttgtattacttccaacgcttaatcagcacttagagttatacgcaaacggctgctgattttcacgttagccaacccacaatctcccaagcaattaaacgactagaacgtcatttccaagtgacactgttctttcgccaagcaaagaccaaggcgctggtgttaacacctagtggccagcaactattgctcgcagccaacgacattatcaacaactggcagcatgtcaatgaatcaatcagtcatttgcgtcaacatacactgcggtttggtatcgaaccatccgtcagtgaacattatttaccggcattaacaaaaccaatcatcgagcaagatttgcttagtagcgtccacacggttgaaatgggggctaatcaactcgtcaaacaggttttagccggccaactcgacttagccatcagtggtaacttggatcaaacattggatgaacggctagcagtaacgccattacggccttttaaatttcgcattctcgctaatgttgcgcaccccttagcaaaggctgagcatccgacttttgcagaagcgctaaaatcgccttttgtactgcttaatgcaacttacttaaataaactagtcttccggcaacttgctgaacaactttcgattgaaccccaagttctcttcgaatctgatagcagcaccttgatcaagggattagttaaagagaacctggcactaggcttcatttccgacatcacgacccccaacgatggtgaagacgatggtctcgttgagattccgttcgacgacgttcaggttcctagcgtgcatatcaacttgattcgtcgggcccaccaatttccaattggcttggtcaaacaagttatcgacattattgaaaaaacatttgcggctgacaatgccgaacaaaaatcttaaccacaaacttgatcataatcatacatgcgctccaataaaaatacccaacttatctagaatgataggttgggcgttcttattggggcgcatttttggttaagtcatcacgattaaatttacacgaccaactcgtgctcgtaatcacacaaccgccgttaaaaatcacattcacaactccagcagcgaagctaattgtgacctaaaactggtaaactttcgcttcgtacgctcgtaatacgtcttgatgatcttcatcgtagttactgatcaacagatgcgcatcagcgggtaattctgcaaagtgtcgcgtctgggttgccgcagtaaagttacaaattactagcaggtgctgcgaccccatatgccgcacataggcataaacggccgcatcatcaggtgataataggtgataagttcccgtcgttatgactggtaaatggtgccggagcttaatcagccgctgataatagctcagaactgaaccgggcgttcgttgcgcgagttgcgcgttgatccgcggataattggcattaaccgctagccacggtgttgccgttgaaaacccagcattctgactatcatcccactgcatcggtgtacgcgcattatcccgcgacatatgggcgagataacctaacatctgttcaggttgaacgacctgttcgtcatcaacaaagtgatgatacgcattcagtgattccaagtcttgatagtcggttaacttggtaaaatgggcattcgtcatgcctagctcctcaccttcgtagatgtagggtgtcccttgaagaaagtgcaatagggtcgctagcattttggctgaacgttcccgataagctggccgttcatccccgaatcgtgacacaattcgcggttggtcatgattattccaatagagactattccaggctgtcccttgtaagcccatttgccacttagacaagctctgctttaggtcaaccagtcggacgggctggtcattccacttacctagcgccggatctggattaccatccaggcccatgtgttcaaattcaaacaccatgtttaattcctgaccttggccgcttgccagttgcttagcatcagcaaccgtagccccaggcgtttcgccgaccgtcatcagttgatggcctgcaaacacttgctgattcatttcttgtaagtattcatggagatgcggaccattggcaataattccaccgattgccgcgtatggttccccagcttctggctgcccgtctgcaatgctatcaggcttggaaatcaagttaatgacatccaagcggaaaccgtccacgcccttattgacccagaaattcatcatgtcatagactgcttgccgtagttgcggattatcccagttcaaatctggctgttcaaccgcaaatgaatgtaagtaatactgatcacggctggcaacatatttccaagcagagccaccgaaaaagccaccccagttgttaggttcatgcccatcaacaggatcacgccaaatataatagtccgagtacggattatccttactttgcgcactcgtcgtaaaccacttattttgatcagatgaatggttgacaacaatgtccatcatgatttttaaccctttcgcatgggccgttgttaataattgatcaaaatcagccatcgtcccgaattctggattaatatcgtaataatcactaatatcatagccattatcgacaccgggtgaacggtaaattgggttgagccaaatcacatccgcgccgagctgtttaatataatctaaccgttgtgtaattcctggcaaatcaccgattccatcaccatttgaatcctgaaacgaccgtggataaacctgataaacaaccgctgattgccaccattgattagccatatatgattatccccctaaaaaagtttgctttaaaaaacttgtcacggtcaaccataaaaggcaccgcttacaacactaaccattctaccattgtcggtcatttgagcgtacccacttatcgctatttatttgttagcctaacacgtttctagccatatcttagttgacgaatcaaaaacgccatgctattatcgcttatattcaaataacgaacgataatcttactttcaagtagcgaattaactgtgcgtcaggaagtcggtgggtgctgcgaaccgatcaggttaatctcgatgaaatacggtaggagaggtccgggtgcgcccggcggataacaactagagccgttaactgctagtgagtggagtcatattgtggctcaagctgggtggtaccacggtctaatcaatcgtccctgttgcattattatgcaacagggacgattttttatattcacccactattatcggcgtacaaccgctgttgaagcagtccgtgtcgggctattcactgctggtttaacgacctcaaaggagttaattattatgcctaattcaaagaaatggcgttcagttcagttaccagaagccctactcgttttactcattatgcttgcaattatgggacttggcgttattaagttcggcctgtcaccacagacccccgttattctcgttatcgccctcatcattttatgggcccgaattcgcggtgcccactgggatgacattcatggtggcatcatcgatggtattaaaactgggattatcccaatttttatttttctactcatcggggcactcatcagcgtttggattgcagctggcatcattccttcaatgatggtctttgggtttcatctgatctctgcgcagtggttcgttccatccgtttttctcgtttgtgcaattattggaacttccatcgggagtgccttcacgattatctcaacgattgggattgccctctttggaatcgggacaacgatgggcatcaacccagctttgattgccggagctatcatctcaggagccatttttggagataagacttcaccgttgtcagattcgaccaacctggccgcagccattgccgaagcagatttattcgaccacattcgtaatctgatgtggtctacgattcctgcttttgtcgtatcactagtactctacgccgttttaggtgccggagccgcaacacaaagccatttgggcaagattcaaacgacgttgaccgtcctcaataataactttaccatcagctggtgggcggccttgccactcgtcgtcatgtttgcctgtgccctacttaaaattccagccattgcaaccttgttgatgaatatcggtcttgccatcgtcatgatttttatcgagcaacctcatattgccttaactaagatcgccacgatgatcgaaaccggctttgtagccaaaactggcaacgccggggtggacgccttactctcacgtggcggtatcagtgccatgatgagcacggtctccttaatcctattaaccctgtcgttaggcggtttactaatgaaattcaacctcattcagacagcaatggtgccgctaactaagcgattgaaaggtgccgggacaactgttacggctgcgattttagcgggaatcggtgtcaacatctttgtcggtgaacagtacctttccgttatcttgcctggtaaagcgttcaaaacgaccttcaatcagcgaggattggctaacttagccctcagtcgagtccttgaagacggtggaactgtcatcaattacctgattccgtggggcgttgccggggcctttgccgctaacacgctcggggtatcaaccttagcttacctgccattttttttcttcagcttactatcaccggtattctcaattatcagtggtttcactggctggggcctgaagcatcagccagccaacgaagccggttaatttaaaactaggttgtttaatttaatcggtgaccgaaccaatcccggaatataattgttactgcttgtgattcgcccccactgctggctacaattagacaagagcatgttttggatcaatctaacaattcgtcaattgatactgcatgatttatttactaataagtcacatcccggcaccacgtcaactaacgaacttagatatgaggagggggattacaatgcttgcatacgggtatcaaaaatttgggggacctaccgtatttgaagaactaccacaatcacagctgattccaacagataatcaattattaatcaaaactttagccgttaacctaaccgaggaagaccgcttagaacggctaggtactatccaaagcgtcgcactaccgcatattcctgggcatgatgtcattgggaaaatcattcaagttggcgccgctgtcactgacttggacgttgggacagtggtggctgcccgcacgaaccatacttacgcggaccaggtttgtttagatagtgatctagcggtgaccatgccaactaatcttgatccggtcaccgccgtcagcttagtcactccagggattgtcgcttacaaaacggtgcgctactttgcggacatccaggccgaccaaacggtgattgtcaaaggcgctggcagcccagtcggcttgttaattattcagttagccaaacgattaggtgcccacgttatcgcgattgctagtgaccgttatgctaaattgattgcgacactgggagtcgaccaattcgtcgactatcagcatcaaaatccagttcacgtgttagccgaccgcggtgacgtcgtaatcaatgtcgctatcgatggcgttggtggcaaagatgacttagcaatggccaaatttgatgcgaccatcgcttcatttgcccgtcacttgccagccaccagtaaatcaattcgtttccaagcaatccaaccgaccgaagtgatttctgatcaggccgccttacaattgctattcaagttgctagatactggtcaattgaccacgacgatcaatgaacaactaccgtttaacctcacgggcttcattcaaggtcaccaacgactagatgagcctcacgtgggtcaagtggtcgtcgcgcgctaaaaaaactgctttcaaaagttatccttttgaaagcagttttttagtcaggtggtcgcttattaagaccatcgcagaattttgagcaacccaattcacactaatcgtaacgattgggtatatttcaaagaacgcctcaattagccaagccctggatacctatgcgagttggtagacccaagcctcataaggccgtaatttatttggctgctgctcgccataattactaatcaagcatttggccgtgggcgtcagatattgatccagtggtcgggacagtgtctcggctgtgaaattgcaacaaactagccaggtccgcccttcccattgccgttcatataagaatacctgcggatcatcggcccacaagagctcaaacgaacctaacgtcactaaggggtattgatgtcgtaattgaatcaagtgctggtaatagtaccacactgaatccagatcagccaaagctgcggcagcattgatttgacgatagttgggattgaccgtgagccatggcgccgcgtcactaaaacccgcgttaacctccgtgtcccattgcatcggcgttcgcgagttgtcccgagaacgcgccgctaatcgggccatcatatctgccggtgatagtagttggcgctcagtcactaaatcacgataggcattgagcgattcaatatctcggtaactggttaattcagtaaaatgagcgtcagtcatccccagttcttcaccttgataaatatacggggttccctgcaagatgtgtaaacacgttgcgagcattttagccgaacgtacccgatatgctggtcggtcatcaccaaaacgtgagaccgctcgtggcgtatcatgattgttccaaaacaggctgttccaagcccgcccttcaagtccgacttgccagtcactaatgactttctttagcgccactaacggtgtcttacgcgtactccacttaccaagaccatgctgactattatcaagtcgcagatgttgaaattcaaagaccatatctaattcgtgccgatcagcgcccgcatacttcagcgcatccgctggtgtcaccccgtgggtctcaccaaccgtcatgatatcaaactgtgacaacacttcttggttcatttcttgcaagaattcatgaactcgcggtccgttcgttactcgagcatcgccaaactgactgtgcggtttcagtggaccatttggtaacccgggtaacttagagatttggttaatgacgtccattcgaaaaccgtcaacacccttgttcaaccaccaggtcatcatcgtataaactgactctcgtaaggtcggattctcccagtttaaatcaggttgttttgttgaaaacgtgtgtaaataatactgctgggtctgctcatcatattgccatgctgaaccaccaaaagccgcatcccaattattgggcgcctttttgccgttacctgagcgccaaaagtagaaatcacgatattgattggtgcggtcctggcgactgcgtttgaaccatggatgctcatcagaggtatggttaacaaccaagtccatgatgatctttaagccccggtcatgggcggcttgcaataattcatcaaaatcagccatagtgccaaagtcggccgcaatttgttgataatcactaatatcataaccattatcatcgttgggtgaacgataaatgggattgagccaaatgacgtcgattcctaattgctttaagtagtctaggtgggccgtgatcccctttaagtcaccaataccatcatgattggtatcttgaaaactccgtggatagacctgatagacaacggcttgttgccaccacttgattgttgctgccataattacgattaactccttagttacgcggtaaggcccttgatgagcttaactggtaacgtatattttgattccagtgtacaattcgcatcctcaatccgctgcaatagtagagaaaccagtaacgtgctaatatccgctaacggttgttctactgttgttaattcagaatgataatcacgtatgagcgccgtgccatcataaccaacaacgcgtaattgctcaggaaccgttaatgacagttgtcgcgcgacgttgagcactagtaaagcggtcaaatcatcactacaaaaaataccatcatactgatgttgtgtcataatcgtcttaatttccatcatcttcagcgcgggggtcaattcaaacggtaattcgtggacatggggtgttagctgttgggcagtcaagtaggcttcatatccttcacggcgaccattcgttggcgaaccagcgtgtgacttaccagtaaaaatagccacgttagtcgcccccgcctgatgcaatgtctgggttgctagccagcccccctggtaattatccgaactaacgatgggaatattgtcggataagtaccggtcaaatgaaataatcggaaggccgtattgttgatattcttcaatacctaaattgtgggcaccagcaataatcccatcgacctgattagccatcaacatttgtaagtagtcgcgttctttttgcggatcatccgcactattacataaaatcaccttataatttttagcaaataagattttttcaatccgagacaccagttcaccaaagaacggattactaatatctgaaaagatgacgccaattaagcgcgtattctttccttgcagtgagcgtgccatattattcggctgataatgcagttctcgcatcgcagcgaaaactttttctttagtctgactactcaggtagccatggttattaataacccgagaaacggttgtcgctgagacccccgctagcttcgcaacatcatttaattttggtttcattgttatcgactccagtatgctctgattggcgccattcccagactttaccggtaactgccgtagtgtcaccttgaacgttaaggcgactcggggtagcgtttaagaagaaacggccggtcatcacggaatagccattatcaatatagcattcaaagactgacacatctatgattagccggatttttatcgtcttatgggccggtaactccacttgacgggtctgaccataatcttcagcaaacgaatttcccgtatgccgccgatcaatcatgacctgaccatggttggcatcaacagtcacctgcagctggccactttcctgctgatcagcaatgttaaccgtgaccgttttatcagcgggaaccgtcagtaagagttcaaagctgccattcaaagcggccaccgtcgcccgttgttgctcaaagactaggtcatgcgccgtcgtccgcaaatcatccaccgctgccactggattttgatagaggtgcccatctttaagcgttagttccttaactaagctcaaacaatgggcccaattttcacaatcagttggataggaaatttcaggtaacccaatccagctgacggctaacgcgcggccatccggcgcattgattgcctgcgtggcatacacgtcaaagccgtcatccaattgcgtcagggcgtggggttcagtgaattgtgcctgagccagatccaattgatcggcaactaggtacatgttcggataaatattctgatacggggtcgttgtttgtgataacccttggggacagaacaataagacgggctgttgatcgatccagaccagatttggacactcaatcatataaccccgcgcatttgcgggaacgttcaactcgccttgacacgtccaggtggtcagatcctttgagaaataaaccaagatagcaccgatctcagtagtcgtctgcgcaccgatcagcgcgtagtagccgtggtcagtccggatcaagtccggatcacgaaacgaactcgtgtacccagccggagcatgcgcaattagtggccgggacagctttttaatgtgattatccgtgtccatccaggcacctaattgatacgattcacgttgccagtcggcagtacggacattacccgtatacataataaataactgatcatcaattggtagtgctgtacccgtgtacgcgccgtgtgagtcgtacggcgtatctggtcgaatcgctaagccctcatcatgccaatccaccaagttcttagaggtcacgtgttgccatgacttcagtccgtgtaccggaccgaacggaaagacttggtagaacaggtgccactgaccatcaaagtatgaaaagccattggggtcatttaacaaacctgatgtaggctgaatatgatgttgcatccgccacttagactggcgtgcctgggcaacgagctgtggtagcttagttgctggccactgttcataaggggtataacgggttttacgattccatatcatgatgataagctcctttttaacgttcgacttaattgtcactattataaaaccgcttacaccgatatgtcaatcgtttgacatttttatattatattttcatgtcagcgtttcaaattcggctttttaacaagattatcaagcaattcaattttgtatcaaacgcttgacatattttccaaacttgttattattgggtctgtaaagcgcttgcattattaaattaaaaataattttagactcagggagtgaattattatgaatcatcaagaagttgccgaccgcgtacttaatgcaattggtaaaaacaacattcaagccgccgcccactgtgcgacacgcctccgtttggtcatcaaggatgaatccaagattgatcaacaagccttagatgacgacgcggacgttaaggggaccttcgaaactaacggccaataccaaatcattattggccctggcgatgtcgataaagtctatgacgccttaatcgccaaaacaggtcttaaagaagcgacccccgatgacatcaaggcagttgccgctgcgggtcaaaagaaaaatccattaatggacttcctcaaagtcttatctgatatttttattccaatcgtccctgcactagttgctgggggtctattaatggcactaaacaacgttttgactgccgagcatctttttatggcgaagtcagttgttgaagtttaccccggtctcaaaggtatcgccgaaatgattaacgcgatggctagtgccccgttcactttcttgccaattctcttaggattttcagcaacgaagcgcttcggcggcaacccctatctgggtgctacgatgggcatgatcatggtcttaccatcacttgttaacggctatagcgttgcaacgaccatggccgccggcaagatggtttactggaacgtctttggtttacacgttgcacaagcaggctatcaaggccaagtgctccctgttttggccgttgcttatattttggctactttggagaagttcttccacaaacatatcaagggtgcatttgactttacgttcacgccaatgtttgcaattgtcatcactggctttctaactttcacaatcgtcggtcctgtcttacgaacggtgagcgacgcattaactaacggtttagtaggcttatataacacgactggttggattggcatgggcatttttggccttctctactcggccattgtcattactgggctccaccaaaccttcccggctattgaaacccagttattggctaacgtcgccaaaacgggaggttcttttatcttcccagtcgcctcgatggccaacattgggcaaggtgccgccactttagctattttctttgccactaagagccaaaagcaaaaagccctgacttcttcagccggggtctcagcgttactcggaattacggaacctgctattttcggggtcaacctcaagatgaaatttccatttgtctttgcagcgattgcctcaggaattgcttcagctttcttaggactattccacgttctgtccgtggcgatgggtcccgcatcagtcatcgggttcatttcgattgcttcaaagtcgattccagcattcatgctcagtgctgtcatctcgttcgtcgtcgcatttattccaacttttatctatgccaaacgaacactcggtgacgatcgtgatcaagtaaaatcaccagcaccaacgagtaccgtcatcaatgttaatgatgagattatcagtgcaccagtaacggggactagcgaaagtctcaaacaagttaacgaccaagttttctcagccgaaatcatgggtaaaggcgccgcaatcgtgccaagcgctgatcaggtcgtcgcaccagctgacggggtcatcactgtcacttatgatagccatcatgcttatggcatcaaaacaactgctggtgccgaaattctgattcacttaggattagatacggtcaatttaaatggtgaacacttcactactaacgttcagaagggcgataccgttcatcaaggtgatctacttggaacgtttgacgtcgctgccttaaaagccgctaactatgatccaaccgtcatgctagtcgtcacaaatacggccaattacgctaatgttgaacgactcaaagtcacgaatgtccaagctggtgaacagctcgttgcgctgactgaaccggcagctagctcagttgctgctacaactgtctaaactttattaggaggacgtcatgcctgttgaatatgaccccaaaaccggcttaatcaatcttcataatgaccaaattagctatgttattcaaattttagcccatcgttacccagtgcatcgatattttggacgttacttttcaaaacaaccgtactttgagccgatgccatccggtagccatgcttttgctaatgacccaacagaacgctttccatattccgtgacttcactgccactcgaatattccactattggcagtggtgactatcgccagccagcttacgttattaaggatgctaacaatcaattactgccaattttagaatataccggtttttctgtgaatgatcagccaatcaactcgcgccaattgccacccaccgttagcaaacacacgcctgtaacaaccctagtcattcatttggccgattcagtgaccaagttacagatggatcttaactacactatttttgaaaatcagccgcttatcttgcgaagcacaactctgcgccatcacggcactactaatttgcaagtaacagccctatccagcgctcaactagatctaccaactgaccaatatactgcgctgacattaagcggtacccatgcacatgaagctaatccatcgtttaaccgtttacacccagggttacaaacggttcgcagtctgcgcggcactagtggaccacaacaccaaccgttcatggctctagcagaacctaacacgacagaattagctgggactgttattggttgtgcactagcatggagtggtaacttcgacagtactgtcgaagttgaccaatatcaacatagccgcctaacaatcggtcttgaaccagatacattcgaatggcagctcaaaccaaatagcagttttcagactcctgaagccgtgctaacttggacaaatactggttttaacggcatgtcacaagtatttcacgactttagccatcagctgatgccctcccagactaacattccaagtgtgcttaacacttgggaaacactgacatttgccgtttcagagtctaaagttcaacacttaatcgaacacgcccaccagttaggcttacaaatgcttgtcttagacgacggctggtttgtcaaccgtaacggtgaaaatgggcaattaggtgactggtatgttgaccccattaagtttcctaatggtctgaaaccccttgcccaacaagcccatcatcatcgaatgaaattcggtctctgggtggaaccagaaatgatcaccactaacagccagctttaccaacaacatcctgactgggtattacaatatgttgatcggacacccatcacagctcgccaccagctagtcttagatctttcgcaggctgctgtccgtgaccacttagtcactactctgacgaacttggttcaaaataaccaactcgattattttaaatgggatatgaatcgccatcttacacaggttggcagcacacgcttaccggctgcacaacagggggaactgtattatcgctacgtctgtggactttatgatattctcacacgcttgaagcgcgcctgccccaagctgattatcgaaaattgttcagctggtggtggccggtttgattttggtatgctaccatacaccaatcagacgtggataagcgatttgactgatccagtcgaccgagcaaccatcgagaacggatttagttatctatttccaccacggatattcagcaaccatataaccgcatcacccaatgcgcaaaatggccgaataacaccatttgaaactcgattacaattagcctgcatcgggcaactaggattggaacttaatcctaaacaacttgctcctagtgaacagcaacttcttcgaggagccttgattaaatatcagcaactgaaatctacttttatcaaggcccacttttatcgtctaccgacaacaagacacgttgttgcgtggttgttagtaacggcagataaaaagcaggcaatttgctgttacttaaatgggcttaattctgctgtcaaaactcagcacccattaccattacactatctcgatgctgaattaacttatagcgattcatcaggtaatagctatacggggcatcagttaaacacgatgggaattccacttaaacccaccaacgctgatttcactagtcagctaatttatttacgtcaaagttaatgtaatcgttaacaaaatttctaattaagagtatactattaataaataagactacatttttaactacaggaggcacactatgcttttaggtgcaattgaagctggtggtacaaaatttgtttgtgccacgggcgctgaaaacgggcaagttagcgaccgaatttcgatccccacgacaacccccgctgaaatgactgcggtagacgactattttacgactcatcccgttgacgcgattggtatcggttcatttggccccatcggcgttaatcccgatgatccgaaatatggttacattaccacgactcccaaacccggctggggtgacttcgattttttaggccatcttaaaagtcgcttcaacatcccactctactggaccactgatgttaacgaagccgcttatggcgaatcaatgattggaatcgctaaggacgtccctaacagcatctacatgacgattggtaccggtgttggcgctggcgtcattagtcagaaccacatttttaatggtcgcactcatactgaacttggtcacatgcgactcaaccggttacctggggacgatttcaagtccaactgcccctaccatgacatctgtttagaaggtttagctgctgggccagcagtgggaaaacgaacggggaaagctgggaaagatattcccgtcgacgatccggtctggccaatcatcgctgactacatcgcacaggcatgtgtcaacctcaccgtcgccttcgcacctgataaaattattcttaacggtggtgttatgaatcaacggcagctctttcccatgattcgtgaaaagtttgccgcctatctaaatggctacgaagaagtcccaccactggatgactatatcgttcccgctggactgggtaacaattctggcattgccggtggcctattgttagctcaggctgctttaaagaacgcttaacaccttgcaaaagagtccgccgatacgcgtttaaacgtatcagcggacttttagtttacagtcaatttgtcattcggttaatgaatatatacggttaaaacagtgataaatccaaaaatcaccccgggaacatttgaaataataacgggccaatccttataagtcttgaaccagccgtaaccagtccatagtatcccattaatcattgccacgagtggttgtagcggcgatactgggtcacctgagaaattcgaaataatttgtggaatatacgacacgtacatcgcaatacacgtaaatgtcgctaacttactaatcaatttcagatatttaactcgcttgggatccacagcgtccttaccactgggatattcaccattatcaactttatacttaataaataatcaccttcctagctagttattatactacataccactcatcacgcaaaaattcgcgttcgttaaattgtatcggcaccgcaacaatcctcaactattcgcacgttgcgcgcaagttgaaacccagcattccccttacatcaaaattgattgaccctatcaattagtttaatttgtggaagaattcccttaatttagctatactcatctgtcactgaaaccgatatcatacataccagcaatatatagatttttgtattttacgcgttgtgctagctaatttgtcatgagtcatgattaaagtaggcaaaataattaacgtcaaaagcagtcagcttaggctcgctggaaagagttcgggttagcgtaaacatgcttagttcaccctacaccgacctccaggcatttctgccaattgccagagcgcggtagtcaaaaatctaagtcgaggccacgttttaattacgattcatgcaatcagcgctcacataacgcggatatgtcaattttgcttagttcacaggaggatatcgctatgagacatggacaatatcgctacattgttggcacactagctttgataacgactgctgtaggtttagtagcttgttcgaaacagtcagctaatcagcagatcagttaccgtcaaacggctgaggccacccttgataaggggatggataatcaacccgaagcaccgtactggtttccaaaacaactgctgaaatggcagttgagcaaggataaagcagccaagtacaacaccgcctcggttccactagccaaacggatcgataaatggcaactgccgacggttaacaagacccaggacccaaagatgaaggtcgtcgcgttatccattatgaatagttcaactagtggcaacgcgcctcgcgggattaatacgttcgatgcgaatgtcttctccaactggcagtatattgaccaactcgtctactggggcggttcggcaggcgaaggtttgattgtgccaccgaccgcagatgtcatcgattctgctcataaaaacggcgtgcccgttcttggaaccgttttctttccacgagtggttagtggtgggaagttaaagtggctcaatgacttcttaaaacaagatgctgacggacattttccgatggctgataaactagtcgcggttgcgaaagcttacgggtttgacggctggttcatcaaccaagagaccgaccccgaagttaaaagttttgattcggcttccaccggaaagaccgcaaccagctcaactagtaatgggctgagcaaaaagcacgcccaactaatgcaacagttaatcaaagaatacaaacaaaaggccggctccaagctagacctgatgtggtatgactcgatgacgaaggatggtaaaatggattggcaaaacgcattgaccaaagaaaaccaatcttatctagtcgatgccaatatgaaaccagttgctgactcgatgtttcttaacttctggtggacgaagaagcgtctcgccagtcaagaattactcaaaaagtcacacgaacgcgccgaaaagcttgggattagcccttacaacctctttgcaggaatcgatgttcaagctgacggaaccgctacccccgttcgttggaatctattcgctaataaacaacatgtgccatacacgtcgctaggattgtacgcaccggactggacacacgcttcttccgatacggttgacgaatttcaagccaaagaaggtgctctgtgggtcaatgatcaaaatgatccgtcccgtagcattccgtcaactacttcaacacattggccgggtgtttcaacatacgcggttgaacaaagtgccattacgaaacagccctttgtcactaatttcagcttaggcaatggctataactacttcattaaggggaaaaatgtttcgctacgtgattggaacaatcgctcactgcaagcagtcaatccgacttaccgctggttaatcaataatggcaatggtaatgcgttaaaggccagctttgactacactgacgcctacgaaggtggcaatgatatcaagttagccggcaaaatgcgtaaggacaccgctagcacaatcaaactctacaccacggacctagacgtcactgccgatacccaggttagtttaaccgctaaggcatctggtaaatctacagctaaactagtggtgaccttaaaggacggccgcactaagaccatcgcgggtgaccggacactcagcaagcactggacgaccgttagctatgacgttagtcagttaacaaaaaaaacaatcaaaggccttagcctcaaaatcagtgccgccgagactgatgctagctacagcgttcaattaggtcgcctcgcaattaccggcaagcagcaggccgcgccgaaaaaggtcaaccaggtcaccattgataatcggaccttcgacgaagaaggcaagtacgctggtgtcaatctgagttggcaagccaccactaaaaataagctggatcattacgaaatttatcaggttaacaatgacggttctcgctcatttctgggggccactaacacgactaatttctatttaaacgcgttgaaacggaatgggcagcacaacgagaccaatctgatggtcgttccagttgatatttggaaccaacgtggcgatgcttctgaccaagttaccttaaaatggccggataatcgtaaacctaaagcggcatttacggttaaccgcaccctggcagctcccggtaacacgatcaagtttacaaatgcctcatccaaaaacgcaaccagctataaatgggaatttgacggtgccacaaagacgaccagcaccgccaaaaaccccacggtcacttaccgtaaggctggcacttataacgtcacattaaccgctaaaaataaggatggccaacgacacgttacaatgaaaaagctcattacgattacaccgaaagctcaaggcgctttaaccttactatccaagaacgccaagaccagtgcctccggatacacgaatagtagtgaagcacctaaaatggcggtggatgggaaactcgatactaaatggtgtgcaaccggtaaggcaccgcataccttgacgctggatttaggccgtcaaacgactgtgagtgcggttaaattagcgcatgccaaagctggtggcgaaggtgctgatatgaacacccgcgcttggaccattcaggtcagcactgatggcaaacgctacacggacgttgcccggacctacaataacacgcaagccactagtctcaatactttcgcggctacttcggcgcgctacgtccggttagtcgtcgataaaccaacccaagttgctgacaccgccgttcggatttacgaaatggacgtgctaggattgacgcaaacactcaaataaccctaccgatgctatttgaatagaacagccgagcccctcacttggaaatcgatatttccaagtgagggactcttttatgtccagacactaaaaaggcccgtatcagctgatacggaccgatttagaagttaggttggaatgaattgagctcattcttaggttggaaacttgattgtggccagttacggtcagaccacaatcaagcgttcatatttacttagttgttacggtgctagcgacctcgatagcttgcccattaagttcgatagtcagtggttccccactaaccagttcaacggtcgtaccctgttgatcgacatccactttaatcaagcgaccgcggaagttaacgtggaattgataatgggtccacgctttaggcacaaacggtgcaaaggctaaggtatcatccttaactcgcataccagcaaagccttgaacgattgcgagccatgaaccggtcatcgacgtaatatgcaagccgtcgaccgtatcattattataattatcaagatcaagacgggctgtccgttcatacatttccacggccttatcctcataatgcaagtccgctgctagaatggcatggacggctggtgaaagactggattcatggacggtcaacggttcatagaaatcaaagttacgtttcttctgttccgccgtgaatttatccatgaagtaatagattccttgcaagacatccgcctgcttgatatacggtgaccgtagaatatgatcccatgaccagtgttgattgattggccgttgatcagcaggaatacttgaaactggcttgacgtccttatcaaggaagccatcttgttgaacgaagattcccaatttttcatcatacgggaagtacatccggtcaacaatatcttgccactttgcaagctcagcatccgtgatttgaagtgctgcacgcttagcggcatccactttcttcaaactcgctaacgtgtattctaacgtccagcgcgccataaagttcgtataccaattgttattcacgttgttttcatactcattaggaccagtgacaccgtgaatcatatactgttgtttccgttctgagaagtggacccgatcagcccaaaaacgtgaaatccccgtcaaaacgtcgattcctttagtcttcaagtaggtctcatcaccggtataacgtgtgtaattgaagatggcatacgcaatagacccatttcgatgaatctcttcgaacgtaatctcccattcgttatggcactcaattccgttgaaggtcaccatcgggtacaaggcaccagccaagccctgcattttagcattatggaaagctccagcaagctgattataccggtattccagtaagttctccgttacttctggtttcgccaatgaaaggtagaacggtactccgaacgcttcggtatcccaatacgtcgcaccaccatacttttcaccagtaaagccttttggccccaggttcaggcgcttatcttcgccatagtaggtcgagaataactggaataagttgaagcgaatgccttgttgtgccgcatcgtcaccgtcaatcaacacgtcagataactgccagcgtttagcccaaccatcaacatgggcctgccgtaagtcctcatatgactgtgtgctgaccgtttcacttaattcggctaagccagtccgcatcgccgccatatccgcgtaatcccgtgaagtcaccacgaggactcgtttttcaaaattcttggtttcatccggtgctaacgttccccggaagatatttgtaactgccttttcggtttctggggcgttaatacctcgaaaagccgtttcatgaagcatctgcatgccgagcgtaaagcgcggtgttccgaagttattcggcttcgtttctgcaaacatgctgccaccagtaatcgcatgactcttgtctagcacttgccagaactgctcatcatagttcgcatcttcattgaagacgtccgcatcaatttgcgaaataaatccaatttggaccggttccgcacccaaattgtgaacactatagtgcacatcaaataactctttttgtgcaacgctgacgaaccgatcaatcatgaattggacgcgtttttcacccttggtaataataaatgaacgccgtaaaattcccgtatgcatatcaagatccaacgtaaagtcactgactgtgtccttcgccaaatcaacttgatcaccatcaatcgtgatattgactttgatgaaattgaccgaattgatcaccttaccgaaataatcgggataaccgttcttccaccagccgacccgggttttatcgggataccagaccccaccgatataaatccctttgagggtatcgttagaatagtgctcttcaaacattccccgcatacccatgtagccgttaccaatactggtcatgctttcctgcaatcgcttatccgtcggtacgagttcatgactaatgacgtgccacggatctacttcaaaaatacgtttcattgttgttgctcctccgtcgttcgaaattaccgaataacatctttagtttcagaatcaaagaagtgggccttcgacatttcaaaagcaacttccacattctcacccgggttatgataatcacgtgcatccacttgggcagtaaatttagatttgccagctgtacaatataacatgctttcggcacctaagaattcagaaacgacgaccttcgtcttaacaattgaatctgacatcgcttcaagcgcaatttgctcagcatgaatgtcctctggtcggatacccacaatcatctttttctggtcatagccttgagcctttaaaactttcaattgaccttccgggacagctacgtcgagtccctcaccatcagttacccgaccatcatgtaaggtggcattgaagaagttcattgaaggtgatcccatgaagccagccacaaattgattaaccggttcgttatacaattcgtgcggtgtcccaacttgcatgatcttaccgtcattcataatgacgatccgatcagccatcgtcatcgcttcaatttgatcatgggtgacatagatcatgttggtcttcaagcgttgatgcatttgagcaatcgtagtccgcatatcgacccgtagcttagcatccaagttagataacggttcgtccaataggaacgtccccgcgtcccggacgatggcccgtcctaaagcaacccgttgccgttgaccaccagataaattggctggtttccgttgtagataatcggttaagcccaattgctcagcagcgttatccactcgctttttgatttcagtattactgtaagttttccgaatcttcaatccaaaggccatattgtcaaagactgacatgttcgggtatagtgcataagtttggaaaaccatcgcgatatcacggttttttggttccacgtcattcataacttgaccgttcatcttgaagtcacccttagtgatgtcttccaagccagcaatcatccgtaatgtcgttgacttaccacagccagatgggccaatgaagaagatgaactccccatctttaatatcaagattcatatcggtaactgaatatttatcgttaccctcatattttttgtaaatgtgatcgagattcatttcaaccatcgaaatccactcccttgttttctcacttctaaactactattacacgtgcaatcgcccgcaaacggttgctttttgatcgattattcaaagctattaatcagctaattggactggtcagcaactttagtcaccgccgtattggtgacatatttaattaatactggttgaccatcaactgtcagcttgccatccacaacttcagtaggaccatctgttaacagattttgatagctaccagctgctagcttagtcgcaactgctgtgacctgaccttttaacggaatccaggctgttaacgcttcgccagccgcacggtaagtaatcttaacgataccttcttctacgactgccaattggtagtccgcagcacgcagtaatggtagttgcttaatagtcactagcttttgaatcagtggtgtcacgtccccatgacgatctgcaaccatggtgtcccgatcgaacaatgatggttggtgttcggccaaaaattcttgcccgttatagattaacggaataccacgttgcatgaagatccaggtcaagttattaacggcttcagctttgctgtgcatcaagctcatcatgcgtgcattatcatgattttccaagaagcgcatcttgacataattaccagggaaagtggcatcttggcgttgtaacaagtcaacataccgttcgaccgtactgcgtccttgccagtaatctttaaaatcaccgaagacgtcgtaatcgtatgtcatatcaaaagcttgataaagttcactgtcagacagacccgtgtagccttgtgaccgcagttcctcaataaaaccactgccggctgactccgctaaccataacgtttccgggtacttcgcattaacctgtttccgcgcttcaagccagaaatcaagtggcactaatggcgcaacatcacaacggtaaccgtccacaaactggctccaatacaagagtgtgtcgatttgatactgccacaactcatggtgaccatagtctaagtctttaacgtcactccagtcgccgaccttattcgtcaactgaccatccgcgtcgtgataaaaccactctggatgttcggttgctaagactgaatcaggcgaagtgtgattatagacaatgtctaacatcactttcattcctaattcatgcgccctatccgtgagtgctttaaagtcagctaaagtcccgtattccggattgatcccacggtagtccttgattgcatatggcgaaccaagtgtccccttacggttgacctcaccgatcggattgattggcagtagccacaaaatatcggttcctaaatccttaattcgttgtaagtcagcagttacgccagcaaaattaccagcttctgagtagtttctaacaaagactgagtaaatcatctcattgcgtaattgcgtttgcgtatcgcgtgccattaatcttcctcatttctatgcttactaattgacctaaagcaacatggtttggtcaacttccggatctttgaattttgttttcagatatacccacaacacaacgaaggccaagctgagggactgcacggtcaattcgatagtgacatcaaaatgaattaagccaatcaccatcgctaacagactcccaatccccatcatcatcaacgttaagttaacgccttcgcggaaattccgaatatgcgtgatcttattatgtcgtgacaagaataagaagaacgccgccccatttacgaggatcaggttgacccccacaataattaatccaagtgccatgagcataaatagaccaatcatcactttattgctttgataccaagaattaaccagaaacgcatgagcgtttgtctttaagttatggcctggcacatacttggctttaaattcactaccgaccgatttcacttgaaacgtactagcatgtaaattaatgacattcttgcgtcctgccatatcatcgttcgtgagatcgaagcctgcaacattatccttagttttaataatgatttgatgtttgacatccttgaaccgctgatcacggtagttcgcagttttcattgccgtttgcatctgatcactgaccatcattttatcaatgtgtggtaaaaatggtgacagattaaaattcgtttggtgattatagtaaaacggaatcggcatgaccattaccgcggtcaaaaagataaataaaacaataatctgtaaccaattaaactgatcacggttggcaaacattcttcgaggtgagaagaggctgccaaaaaaccggaccggaaaggcggttgttttgtttttcgtactctgcatctaatttcacccctactaatatttgagttaacccttgctgccaccagcgagcaatcctgaaacgaagaaccgctgtaagtagaagaacaaggcagcaattggtaacgcgactaagattgcccccgctgagaagagcacaacttgttgattttgagcgttattaatgaatgtctggagtcctacggcaaccgtataatgtgattcagacgtcaataagaacttcgccatcaggtaatcttgaactggtgacatgaaggcccataacgcttgaaccgcaatcattggtttaactaatggtaagacaattgaccagaaaatcttgaaattaccagcaccatccaacttagctgattcatccaaatcatacggaacattgtcaaagtaacctttcatcagccaagtgttctgtgggatcccaccaccaatgtaaattgcggtcaagaaccagtaatggtccaaagcgttcaacatgttagctaagacgtagtaagcagtcaaagcggccatggttggtaccatttgaattacgatgaaaaacgttagactgaactttttaccagcaaaacggtaacgactataaacatagccggctaacgtcacaacgatgacttgaatgaccatacatgagactgaaataatcatggtattcaaataccagctaccatacagggtttgcgtaaataagttcttaaagttaaccaacgtccacttaccaccaaaatcaaggacgaaggcttgcacgttagcatccttaaacgccgtgatgaatgtgatcaaaacgggataaataataataattccgagaatgaccatatacagatacgtaaagaattctttccagaaacggtgccgacgcgcgctattttgctttgaattggcattcttaggtgccactgcttgtgcattatccataacactagtcccccatttcaaacgcgtgggtcttcttgaagacaatcaatgagatcccgataactaagacggaaataatcaacgtaacggccgcggccaatgaatactgtggtgacgtccccgttgttaacttgtagatccatgagatcaggatatccgtcccaccggcgttagcaccgacatcaccagggccaccttggttaaacagatagatcatcgagaagttattgaagttaaacgtatactgcgtcacaaagattggcgctgcaatagcaaaaatcgttggcaacgtaatcttgttgaacttttgcattactgtcgcaccatctagcgttgcggcttcgtagagatcttctggaatcgcttgcagtataccagtaatcataacgtaaatgtacgggaatcctaaccaaccttgaatcataataatagcaactttagtccagaacgtatccgtcatccagtggatcggcgcaatgtgagcaaatggaactaacgtattccataagccgatgacctgcacattgatcgcaccagctgaatcattaaaaatgtttgaaaaactcataattgatacaaacgctggaatcgcccaaggaagcaagaaaatcactccgaagaagcgcttacctttgatgaagttttgattagcaattactgcggtggcaatcccaataataatttgtaacgtggttgcacatacggtccaaataacggtccaaccaaaaacagcgttgaaggttgcccggtaactactcaagaagaacattgatgtgaagtttttgaacccaatccaatccaataacatagctggtggaatatgcgcaaaatcatagttcgtaaaagccatcagtagtgtaaccaatactgggaacacaatcgtaaaaaccattaaaatataggccggtgtggttaataaataagcaaagccaccatctactaaactcgcacctaactctttaaacgtatgggagacctttttaccattattaattaactgtgcaacgtgtttcgcatcgtaaaggtttgcaatataaaatacgataaacacaattgtcaatagaatctgcaacgtcccatagatcatcatgaacaaagagttgtcttccattgagactgaacccaatgtgactaaattggcaaatgcgctaaagcccccgaagatgaactcagcaataaatgccaatagaataataatgaagccaacaccttttatggtctgaccgttatacagctgaccgagcccgggaataattgacaggcgttgcgctttctttacatccttgacttgcatgtcgcccgcacccctttcctaaataaattctaaatatcgtgcatttttccttttaaaaaggctgagacaaaacgaattttgtttcagcccccttaaattacaattttaattacttatcatacttttgtgagatattagttaagatcgtcttttgcgctttattagcagcttgctttggtgtcatcttgccgctagcagcattggtaaccatcgtttgtgctggtgtccaaacttctgacatttgtggtaagttgatcaaaggaacatccttgtcgtattgctttgaaacggccgtagccatgtcatcgccagtacttacagcttccttacgagcagctgtgtttgctggaatttcactagcagacttgtaaagcttgttttggttagtcttgttagagatgaagtctaaccaagcttgtgcagcagtcttatgcttagagtagtttgagattgcccaagctttaccaccggcaaacgcttgataatctttgccgttattcaacttaggtaaaacagcaacaccataatcgatattagacttcttgtaagttgcagccatccaagggccatcaataacagcagcagtcttattagacgtaaattgtgaggtcacaaagttttcgttagaagtgacattttgcatcccacttggccagtacttcgtaaaccacttcgtcatgtaagttaaaccttcaacggcgccagaattgttcaagcccatcttcttggcgttcgtattgccatcagcaaagacgtaaccaccataacctttgatgacaccaaaggcattgtagaagtttgtccattgagtcaagaaggcaactgacttagtcttatcattagcgtaagcatacttcttgtcagaagctaacttttcaagttccttgaagttcttaggtgcagtcttgattagcttcttgttgtagtacagaacgtcagattcgatcgttacaggcgctgcataaaccttattcttataagtaacagatttcttccccgttgcgttgtaacgaccactggtcaacttgactgttgatagttgaccttgtgacgccatttgaccaacccggtcgtatggtgccattaaaacatcaggacccttgccggaaggaccatccagcttcaaagcatcgtcttcatcaagcatggccttgtatgaaaccttaaccttaacgttgtacttcttttcaaactttggaatcaccgatttcatgtatgacttatatgaaggatccgctgaaacctttaacgtcttgtccatctttgaactactagatgaagatttactattaccacaacctacgagcgtgagtgctaaaccagtggctaggacacccatccccaactttttccaagtactcatagtgcttcctccttgcgaagtatcttaattcatttaccataatttattatgcaactgtgcaaacgctttcgcaagcgttttcgtaatgttaacgttaacagaatcataccaaaaataaatcctaacgcttaaaaacgttaggatttattggtccatcaacctttataccaatttatataaagattgataagttaattaaaatacatcacatgatttatatataccaattttaggataatcatgcactcacattgcttatgccgatttaacgactaagctactccaagctggtaacgtcacttggcgtcccctatatgttgcaccaccctgtacaagcaacactttaccaccaacaaacggcaacagatacgtttgcgcttgcgcacttaaattacaaactatcgctgcttgtttttgaccatcatcaatgaggtaggtaaagagttgttcagcacttccgagcataatgaactgaccattagtaaagggtgcgcactgctttagctgcagcaactgttgataatagtgataaatactgtcggggtcagcgatttctgcttgcgcattcatgtcatcagtatcaccatgtttccatggtaagtggtcagagaaaccatgataaaccgtattgtcccattgcatggggccgcgccccgccattttatgagtttgattcaacatccgcatgatttccaccttagacttaccagcggcttgagcgctcgcaacaaaggtgggtaccgtctggtcttcaaagtccgcaatatcatgataacggatatttgttaatcctaattcttccccataataaataatgggaataccacgctgcaaatacagggccgtcgctaacgccttggcacttgcttgcggataatcaggatcaccgtaacgcgtggcgacccgagccatatcatgattattccagtaaagtgttggtagactggtgtctgctaaagccgcttgaataccgaccgtattttgcttataggccgtcacatccatcggtcggggctgaaatgtgtcggagaagctcggatcatcctgggtattgtcgtccgcaaaagttctgaacgtaatcacttgatcacactcatccgtacctggtgtcgtatagtcgaccatcaaatgggggtcagcggatgacgcttcaccgacgacgtacgtatccgggtgcttagctttgattacggcgacaaagtcgtgtaagtactgatgcactttcggtaagtgggcataaaacatatcgctaatgatgggtgtcgaatcaccagtccgatttggataagtttggcgaaaatctgctttagccagatgaataaacgcatctaaccggagaccatcaatccccttttcaacccaaaactcagcaacatcacgcatcgcctgttgcactgccggattcttccaattgaggtccggcatccgtttatcaaacaagtggaaataatactgtgagccgcctgccggatccttcgcccaaacactgccaccgaaaaacgaaccccagttgtttgggcgcccaccatcggctgcgggatcttgccataaatagtagtcccgatacttactctgtggatcagcgagagcttgcttgaaccatggatgctgatctgaagtatgattcaagacaaagtcaaagataagatacatgccgtgctcatggaccgttttaatgagcgtctcaacgtccgtcatggtccctaagctcgaatcaacttggtagtaatccgaaacatcgtagccattatcaacctggggtgattgataaattgggtttaaccatatcgtggtaatcccaagttgcttcaaatagggaatcttcgcggtaattcccggaatatcaccaatgccatcgtgattactatcgttaaaactcttaggatatatttgataaatcgtttgttgatcataccaatgcttgctcatctatccagactcctctttaacgggtcgattcagccaccgacaaccgtgaattaatgatgattttttcttgatcatgccgcccgcgagaacgatcagtatggttgatattagccaataatagccgtgcagcagctcgtcccattgcttcaagcggttgcttcatcgttgtcaaccgtttggctgcaatctgatttaataacacgccatcaaaaccgataatgccatattctatgggaacgcgaccaccttgattaataattgccgtttcaacgccgatcgccaaccgatcacttgcacaaataaacgccgtattacgtggaaaaccagaccaatggctcttcacatacgcagttgcaacgtgtgaatgattggctaatcgaataatctgagcgctaatatgatgtgtcgtgacgtactctcgaaaacctcgttcacgatctagctcaaacggttcggcaatagcgataccaataaagacaagatgcgtataaccctgttccgcggcataacgtgtactttcccagaccgcctgataattattagtatcaacgtagtcgtatccctgacgattgctaccaacaaagacgactggctgattaagacgttcgacccatgcgtaatcggcttgccgaataccagtcaaaatatagccatcacattcgccaacctcatagctattgcgcgtcgcaatctgcaaggcgtattgatgttgattcaattcattcgcaatccccgcgagcaacatcatgtaatagggttccgtcgtgtccatgtcttcaaaaatcgttaattttacaacccgggttctccgccctactagcgctcgcgctgccgcattcggatgatagtctagctgtgtcatcacatttaaaatcatctctcgaagctcaggacgaacctgttccggatgattaatgactcgtgaaactgtcatttttgagacattagcttttttcgcgacatcgtttagcgttatcataatcaaaatacccccctaacttactactgtaaggacttgatttggtggacggaatggcgtttaacaatttgatgaggcacaattactgccgttgataattcatcagcaggatggtcagccatcgcaatcttggccgcttcttcacctaaacgctgtggaaagaccgcaatcgatgtcagcatcgggtgcgctaaatcagaaaaaatggagttattaaaaccaatcagtgagaattgtttaactttccagttcggatcattatggagaacctgttgtaatttcaacgccaacatatcatctacggccacaaacccggtaacatctggatactgttcaaaaaacttatgtagtgttttaacacccgccgcatgagtctcaaaccgttcttccaacataatatttggtaactgattttgcatcattacacgttgatagccaagcatccgatcactttgcaccatccgtgataaatccgaatacaaaaacccaatgcgccggtgtccatgatcaattagatattgggctgcatccgttccggcttggatattatcattatcaacatacgatgttttattgacgtcttggtaaggtttaccaatcacaacgtattggacatcaaattgcttcaagcgctcaacaactgggtcatttttttcagaatacagtaaaataaaagttttgatatggccttgtgcaatcatgacatcaatattatgcaccagttcatcacttgaaatccccgttgctagcgttgtcattgcgccattcttactacaaacttcattgataccccgaatcatctctaagaaaaatgggttagaaaagatttcgtgatgatctactggtagtaccaccccgattgtattactagccttagttgctaaattctgcgcattaaaatccggcgcgtaatttaactcccgcgccgctttaatgaccttgtcacgtgttggcttactgataatcttgctaccatgcattgcacgtgacgctgttgaaggcgaaacacctgcgcgctgggcaacatctttgatcgttgccatcatgatccccccgatctatttgaatccatctcattaaatataaaacgttttcatcgttattgcaagcgattgcataaacttgcattatttatttaattatactttataacaaaaaactgtgcccaacaaaatcggcacagttgtgagtatttaactaataattgtttccagaccagctgccaaaataccaccaagcaatggaccaaacattggaacccaggcataaccccaattagccaatcctttattaggaaccgggagaatcgtgtaggctaatcgtggtgcccaatcacgcgccggattaatcgcaaagcctgtggttccacccaaggtctgaccaacgacaacaatgagcagccccaccatcaatggctttaatccctgggtaaagttaccgagattcaacaacacgaagataaagaagaaggtcgcaatcgtttcgcttagaaaattaaataccgggttactgatggctggaccagttgcaaaaatgccaacttgattgccatctgccgccgttttggcagcttgaaagtgtgggtagtactgaataataacgattaccgcgccgataaaggcccctaagaactggcctaataagtacggccaaacgttaaccattggcaaataaccgaataacgcaaaaccaactgtcaccgctggatttagatgaccatccgaaccaaattgtccggcaacatagaccccaaacgtaacggctaggccccacgccaagcaaataaacgtccaattctgatggcgtgcataattaccctttaaattcatggcggcaccactaccaaccccaaatacaattaacaccatggtacctaaaaattcacctaaaaaaccgtgcatgtttcgtcaccatcctacttgatttttaatggcgctaattgagcttcgacatccgcaagtggcacagccgcctgtaatagcgatgcggccgtgtaggcactctcaatgagtgccgtatcatataaatggaccgttttatcactcatttcaatggccatttccagattcattttggcactaccaagatcataaaaggccaagagttcatccgcatgatttgcatcaaacgcttgtgtaattttggtcaggctggttccgacttgattgtcatccgtaccaccagcaatcgtaatcgaaacgtcctgggcaacttgccctaacaaacgctgaatacctgcggcaatttctgggacgtgtgaaacaactacaattcctaaactcataagattccctccgtatccagtaacgttgtaaataaataaccactcgagacagcacctggatcaaggtgtcccactgaacgttcacctagataggatgctcgcccttttttagccaccatcggttcggtgctagcaactgcatcatcgataacatcctgcgtcaattcgcccgcttggaccgcctgaacaaccggcgcccacacatcaatcagcgtcttatcgccggttgtcgcgccaccccgcttttcaatcccagctaatgcagcggccaacaatccacctaaatcgctatcaatcttactttgctttgccatttctaagaaagctgttccgtacaatggtccagaagcaccaccgactttgctaatcaatgccatcgccgttgcttgaaatagtttagttatgtctgctggttgcgtggcaagtgctgccttaactgctgctaggccccgagccatattacccccatggtcaccatcgccaatcggcgtatctaattcacttaggtaactttggtgttgttcaatctgatcagcaaacttattcagccatactgttgtgttctcaactgttaacattctcaattcctccttatgaccacgcgattgttttgaccgggtactgtaagtaatctagccattgagattcagcaacatcgaatatcgtcagtgaaataccggccatatcaatcgaagtcatataattaccaaccttcataaaggccggttgaatgtgccgtgttgccagttcatccaacaagtcatggcaaaagacatactgatccatcaatggcgtcgctcccataccattaaccaagaacgcatactgatgatctgactgtaggtgtaattcatcatctaatttacctagcaattcctgaacaagttgtttggatggcttgattttttcgcgccgataacctggttcgctatggattccgacgccaaactcgatttcatcatctgccaattcaaagccaggtttgccgacttccggcaccgtcgctgcggataatgcgaccgcaatcgttttaatccgtggtaaaacatgcgttgctaaactttctaaatcatccaaatcagcgccttgatccgcggccgccccaagtatcttatgcataaagatagtgccggcaaccccgcgacgaccctgagtatataaactatccttaacagcaatgtcatcatcaacgacaatcgatttaacttgaatatcatctaattcagccatatctttcgccatatcgaaattcatgacatcaccagaataattcttcacgactaagaaaacgcccttaccttgatcgacagccttaattgccgcataaatttggtctggcgtcggtgaggtgaaaacctgtcctgccacggcagcgctgagcatgccagggccaacaaagccggcgtgggcgggctcatgaccactcccgccaccactaacaattccaacttttccctgcattgaatcttgatcactacgaaccattgcttcggtatccggtaatttagttaaatactgaggataggcacgtactaacccatcaaccatttcgtcgacgacattcttgggatcattaattatttttttcatttttgttgtccttcctttctcgaattaacacgttaattgtaaatgaatccgctttcaaaaataatggacagtttcgttattttgtccgccagcttctgacaagcatggtcattcgaatgcgttataataaaatcaaattaacaatataagaaggtgttcccatgcaaatcattaatgaacctcaaaatgccctgagtcaagcaactcagggcattcaatgggcctatccaaatttaacatgggtaccaaatacattcggatgttacgacagcaactttcaagatgatcagattccgttaattgctggtgggggcagcggtcacgatccggcacactggggttatgttgggcctggtatgttaactgccgcaatcatgggaacggtttttcaaccccctacatctcaagaaatcgttaaagtcacaaaacaggtgacacgccagcgtcgcgtttttttcattgttaaaaattttccagcagatgttagtgcgtttacggctgctcaacaacaactgcaaaaggaacattggcaaactggtctatgtattgtggcagacgatatttccgtggatcatgaatctttaaaacagcgccgacgaggagttgctggcacgattttagtgcataaaattcttggtgccgctgcagctcagggggcctctatcgctgaattgacccacatcgctgccgccctagtgccaaacattcacacgattggggttgctgctagcggcgcccgcattccaggacagtcaacggcatcgtttaacttgaatcctggtgaaatttattacggtatcggtattcacggggaacccggttatcggcgtgaaccttttcaatcgtcagaacgactcgcacaggaattaattagtaaattacgtctcaactttaagtggcatgctgacgaccattacgccgttttcgttaactccctcggtgggacaacgcccatggaactcatggtgttcaataatgatgttcacgaattactcaccttagccgcactaacaatcgacttcaacaaagtgggaacttttttaactgctaacgggatgcatgggttgtcattaaccttactcagcctagccgaccctgactggttaactgctctaaaccgacccgtcaaaactgctgcttggcctaactagttcaaaatttcgagtgtcatttcgatggccgcaatagcgtgctgagaaagcacctcataatcttcaggatgattcgcaacgatattatgcgttaacgattgtgcgattcccaagcacagcaaccagattagggccgccgtttctgttgtattggcgtgcgttagttcagtcaataacgtggctaagtggttaccgacaagtgccgtcacgtcaatttcatgctgcgtgttaatacattctgcataaaattgacgattcgcatctaactcgtaacaaactagtttaataatgtcgatccaaggcaaataattcagattatgttcaaccgtttcagtcagggtgtcatcaataaaccaggttaataattcatatttatcttgaaaataatcataaaatgtttgccgtctaaaatcggcggtgctcataattgccgtcacggaagttcggctaaagcccctcactaggacgacgtcatgaaaggcttgtgcaattttcttttttgtaatgtatgccattcaaacgcctccatactgccttttatcaacattgtagcgataactgcaacccatgtccaacgggagccatattccggattaattgatcgctaggagaaacgctacataacgtcatagcgtttctcctagcgatatttttatattacttataaccaataatttcaggtctagtaattctcaacaaattcccctaaaatacattcaacacacttagggggcttcaattattatgacatcatcactcacggttcggcgtatcccgttactcggtgctttaattgccatgcaacttatcttaggaagtttactgtcaattcaactattgctaaccaagatatccttcgcgtttattattattggtttaacggcccgtttattttcaccactagttacagccggcagtagcgcgatttcctccctactcggaatgctgctcttcccaaagttcaccttttttcctggttttatcctaaccgcttttctgaccgggttagtctttggatacgcctttcaacatcaaacttcactgacacgcgttctcgtcgctaactttatcgtcgtctttattctcaatttgtttctaaacagcctctggcttcatctcatgtacttaacaccatggtccgttttgctaacaacgcgcatgatacaagaagtcataacctacgtctgctactcagttatcttgattgccctatttaagattccgattctgaaccagctcaccgcacgttttaagtgacggtggtcattaattatttcgttaattaagtaatgactggtggtacttaatttaaagctaagtaaaaaaccaagggccacagtacattgctgtgacccttagtttttgtgcaaacaattgattgtcatacgaccccgtcagacctaccaacagtgccgaactcgacttcgtattaatttaatgctgccaccattccggccaaaaattcagcggcaccgcccacgaaaatttgttgtgaatgcttgaagattggcgcttgttcatccgtattcacagaaagaacgtgttgcgcaccagccatgccagccaagtaatcatcatcaccagcgacgccaatgttgatcaagacttctggcgcaaccgtcactgctgaggcaccaatttgttgctcaatgctaaattgttccatagccgttagcggctgggtaacagccaatgctgcaccaatccacttggccaattgttgggcttgaagcaatactgccggttccatcgcgcctcgacctaatgccacgacgcgtttcgccgtagcaatactgccgacattgactggcacatccctagtcaaattcaagcgttttacgacccgatgtaggtcggccacgactaggtgctcaggagctgtgtggggtcccgttgtcgggacatcggccacttcgtcattcaggctcgtcgtggcaaaagtcaacgccaattgcgtatccgtgccaacaatcaacggtagtgtcgccacgtcattttgcaaggcacttaacggcgagtgttgcgtataggctagatcaccgatcaatggcatcaaaattttaaacggcgccaaggcattttggctggcaaacattgccgccaattgcgctgcgtctgtaaatgggcgctcatcatcggcctgttgggccgcattgtagacactagtctgtaaggcggccgtaatcgccattgctggcgccaaggcagttaacggcggctgttctgtcagcgctaactgtcgtgcctggtctgtggcatgttgccatattcccgctgtaatcgccccggcaaataattgccccaagctttgcgcccgttgcatcactcgttgtccttgtcccaattgaccgatttgatcagcggccgtaaccgggacatcggtgagttgaacatccgcgatggtcaatccgtgtaaccctaaaggggttattggttggctgaccgtgacgcctggttgatcagcactaataacaaaggcccccgtagcattcggtggtgtctgtgcgagaactaaatactcagttgcctgtgtaacattcaataccgctttaaccgtaccggacagttgccagccagctgttaccggcattgctttgacggtactactagccatgacttgttccggtaatgccgcgagtccaaaaacacctgattgtgcacaataccgttggcgttgttgcggggttccaaacgttaatattgcatcctcaacttgccaactactggcaaaactcatagcgagcccagctgaactttgcgccagtgctaatgcactcaaaacccgttggctcaagcggtcatctggtagcggatcgtccaaagccaattgctgggcaagcgttgtcagtgtcggtcgatcgactttcccagtcgactccatctgcatggcgagtcccatcagttgctcacgcgccagtgccatcaaccgctgccacagtcccgtctgtcgtgccgttaaatgtaattccattccgatccctcacttcatccgtcatctattaagtctaacttaccacatttttagcctgctaacgaaaaaagcgaataaacattatcactattgaacgctgccgaatccaccggtcgaaaaacagtcgtccggattaaacatccgtcgactgttgaaatacgtattattactgctggtcatctaaatctgccgccataaacccatgttctaaaatcgccatgtagttttttgcgcgactgaccacccattcgatatcggccatcgattcaacttgatgattctcacgcatataggtctgaaattccataaaaatctgattgtaaacacccataatcaaagcaatcgttgcatcacgatcaacatccgcacgcagcgtcattttatccagcacctgactgatcatttcccgggaaatagtcatcgacttagtatacaggatcttcatttgtgcctgtatctttaccggcaagcgctccagcgcgccatacgcgtcaatcaagaccttcatttcatccgggtggtctttaccaaacgccgccttgtaacgcgcactccgcaccatcaacgtgactaggtcatctggaacatcaaaaacttgttgattaatggtggcaataatcgtgtcagtagcaagctgaacagtggccaaatacaagcgctgtttgctaccgtaataatgaaataataggcccttagacaccgttgccgcggacgcaatcacatccgttttagcatctcgatagtcactgacggcaaaggtgtgcatggccgcgtgcataatacgctcgaccttcgccgggtctttaggaacaggttgttttactgccatgtcacgcactcctttcgtttactgagctagatcacgccgccgataacttagtgctgctactactaatattagcacagttaataacaggcaccagctacttgtcgttccatctaagggcttgattggtaccttgttaacaaagccaaggggcgttaaacggcgtgcccattttggcaaatcaatcaaattaccaagatacaatgagaagaaggcgtaaaatacccagatccacgcagcataccgccatttaggtcgccagcccgctaaggcactcgtcaccgctaccatcactaacatcgccggtgcataggccgcaaacacgtgccaataggtcacccaactgatgggcttgaccatactcgtcaggcccatcaaatacataccacttagaccggcaagtaaaacgagcagtcccgttacgattgcccagccggtatagcttgcccacacgtgccaccgtgatgtggccgtcgcataaacttgatgtagatagcctttttgttcatcattgaccagtttgagcattaactgtactgctggaaccagtgcaacgatcaccatgacgatagccaacacagcaatgaaatttttgacgatcaagcgattcgctgctgctaaagctaacgcacctagcagttgtttgatcattggattgctctttgccagatcgccaatcgtattaaagacggacgcatacgcggcacctaagataaagttccctagtagccatgcaataatcagaccatgtgcctgccgccataatagggtcacgggaccccgcaacaaaccgctagcctgtcgccgaccgcgccgtgattcgactaagcccgcgcccaagtcccgataagcattaagagctgcagccaaacttaaacaaccaagacccagtaatacatacagaccgattggtaaccaatcattggtttgatacgcatctaatttttcaatccaaccaaaggggatccaccaagtcaggtctggacggttaacatccgtgcccattcgtgcaacgtacatgacgcccagtagcaaatagctcagcatcgtcgtatcactcgcactagtcattacctgtgcaagtaacagcgtcaacattccaaaagcccagcctaagccccctaagcccagaccaattaaccaattacctggcgtcgtcgctcccggaagcttggcgacggtcagcccgagggcaaaaagaaaaccaatcaaaccatttagcgccgttaactcagctgccccggcgaatagtggtgctaaccgaccgaccgcgtgggcacgcactagctctagaaggccatcatcttcatccccgcgcgtcgtaaccacggccaccatgatattcatcacaatcatgacgatggccataaaaaccaccatttcagttgcaaacaccttggccgtcgtatatggcgatttggccgaaaacgcaccaaataaggaaatcatcgcgggcgttttaagcgttttgacaatttcattcagtgccatctgagtgccataaataccatcaaacttcgcggcgatggccgtgaatagccccgtcaacacgacgacccaaatgagcaactttttccaatctcgtcgtaagttgaaccgtatcagtaatccggtacgagcaaatagttgtgttgccatcagcatcacttccccttcaccggttgttgttcggtcgtgtaatagcgcatgaataaatcttctaacgttggtggggtcgttgttaagctgatcagtttccgactcgccaagtactgcactaccggcgtcaattggtcagcatcgacggccagactgacgtggttatctccgtggcgcgctgtgactccgtgaacaccagctagggtggtcaagtcggtcaaaggcagtcgtgtttgcacatcgaccgtggttcgggtcaagtgccgcatctcagctaacgaccccgtttcaacaatctgtccctcacggataataccgatgcgatcacacattttttccacttctgacagaatatgactagataacaggacgctcttctctcgccgttttaaagccaatacttcattttgaaacgtctgctcatttagcggatccagtccggacgttggttcgtcaaaaatatatagatcagcatccgttgagagtgccgcaatcaaggccaccttttgccgattacctttagaataagtgcgcgcttttttacgcggatccagttcgaattgtttaattagcgcgtccgtcttagccgtatgctgaccaccgtttagtttaagaaacaagtcaataatttccccaccacttagattaggccataaataaacatcgcctggcacataagcaattcgcttatgaatcgccacactatcctgccagacatcgcgaccaaaaatcgtcgcctgcccaccactagcttttaaaattccaagtagtacccgaatagtagttgatttaccagcaccattcggaccgataaagccaaaaacttcccccgcgttgatttcaaaattaatatccttgagagcctgaaacttcccgaaatgcttttgcaagtgactaatccttaataacggttctttatccatatgactcactcccatccttcaaattcgagcatcttattgttgatgctgcaatcataggcgccgttgactgataagtcaatgactagccagtcaatcagttaaaaatttcattttaaacatctaatccgcttgaaactggcttcttaggctagtcaagtcaacaaaaaaactgttttggcgataaactttactcgctaaaacagttttttgacatctgaatttcgatggcagaaccagaaagatatatcgtcttcattagccactagaagatagtggggactaacccaccatccgcccgcaatgcttcaccagaaaaactgctagcaaacggactagcgacaaacactgctaaccgaccaatttcttccggccgaatcaaacgctgaatttgtgatagtggtcgatgattaatcataaagtcatgctcccactgatcctttggtaaatctgaatcagcatacatatcatctaacattttctgaacaccttctgttaatgtcgagccaggcataaccgtgttaaccgttacgtggctaccaactgttaacttcgacagactcttcgctaaagaaaggttcatcgatttagtcatcgaatattggggcatttcccccgaaggcataactgcttcttcactcgcaataaagataatgcgtccaaaatcttgggctaacattgcaggtaaataatgttttgccaaccgattgccagacaacacgttcactttaaagaagcgttcccaagttgcatcgtcaatctcatcgtaagccattggcccaaagattcccatattgttgaccaatacgtcaaccgttggaatttgttgaaacattttgtcagcttgctgcggatcactaatatcatacggtgccgccactggatgagttgttgggtatgccgctgcgagttcatccacaaccgctgccaccgtatctgtgcggcgaccattaatgaccacatccgcgccttccttggcaaatgctaccgcaattgcccgtccgattcccttagtcgaaccagtgaccaagacccgtttccctgctaatcccatttccatgctcaaagttcctccgttctaatttaaattgctcgttaagtctaactagtttgatcaataaacacaaataatcggtcctcacgggtattaatctaactcgtttatttcccgggtaataatcgcaaaaaagcacaccagtctcctggcatgctaattatgtacgcatcttaatccgcgcttgatttcgcatattcttctaacactggcataacgtagcgttgttctgcttgcttacgtgccatgatggcatcatccatatcagcaaactgctgattcaaaactaagcggccccgatacattaaccgtgcgacccacttctgtgagcatcggtcaaaggaaacaccaatgaccccgctccgattccggctattcggtttcaatcgatcgaccgaagttccttgataaagcggtaagttatcactacgtcccatatttttacgggtttgcggattttcaaaaatattctttcgactaacatctgcccgtaaacagccacagctcttcgtaatccctttccgtaaccgataactatcgacaactacttgtcgtccacatgaacactgacacaaccaccgtgcattaccattcggcgcactttcagcccgttcgataacggtcaaacggctgaaagtctcaccagttaaatccttaagtcgcatcaaaatcacctcactaagctttctgtgtaatcagctcaattgtcttcaacacaatcgagcttgtactatttaagttaacccgattatatgaaatatttgtgacgaataaaaaaacttttatagtaaaattcgcgcaatatccattaatttccagctgattaactaacactcaacctattccagctttgtcttttatttagaatactactattatgattatatgtcactttttatcatttatattatcatcagaccggtaaacacaaaaaaaacgttagtctcagaatagtctaacgttttatatgttaattgtacaaacaattattgccaatcacacaaaccagcccagtggcgcgagccctaaccagctcagaacgttgacgttagtgtcagtcgcaatgaacggtcgtaaagtctgtttgatttctgccgcgttggctagcgtttgtagatcataccaatactggccctttttactatgaccaactaaggtccaccgacctaacgactttaatgccggttcctcagtgtcaagatcagcagtcaatgcgctcacaaaaacgtgcatcgtcggcatccaggccccgtcgtactgttcagtgtcacgccgtaactggctgatttgattctgcaaacgatgtgccgtccgatacagtcctaataccgcgagaagtcctactaacagcattagcatccagacgcctattaaatctgtatcaccctgatgaaggatcagtatcaaaaacaatccccataccacaacccctgcataaagactgaggttgatcgtattcatcgcctgatcacgtaactgcaaagctacttgcaaacgaaccttaggatcagttggtgccattgtcgtttgctgtaatgctggttggtcgctgccggtatacacaatcttaacatctggttgctgtacttgcacttgggcgagaacttgaaacgcgctgttactgttgctcatgtcagccgcgattgcttgcggcacatactcactaaagacccgataaatcgtcggcacttttttaaactgataccaatttccatgaatagccatcaataaatagcgtcgctgcgcttgcgcattcagccatgccaactcctgttcagaacctttgatcaaaaatcgatgccgccacatacctaccacttccattttaaaagtttaaacaaatccaattggtgccaatcccagccaacttacaatcgatacagaaacgctatctcccacaattggctgtagcgattgcttgatttccgcagcacttgccagcgtcttcaagtcgtaccagtacatcccgtgatgatctttaccgacgtaagcccacgcccctagaccagccactttttctgtatccagctcggtggacatgtttttcaagaaaacgtgcatcgttggccgccaagcatcatcatattgttgcgtgatgactcgcagcgcattcgcctgtttatgcagccgacttgcttgccatgcaggatagaaggtaaatagcaaccatgctagcattccccaactggccacgttatcactcacattcaggctaatcacgatcacggccagtatcagaccaaccactaacctaatattcataacatttaacaagtgtccccgttgcgccagtgcaattttcaactgcaacggtgcgtcctgacgatccactcgcgccccctgcaactcagtctgagccgtgcccgtataaatcacctgtacggctggtttcgtcaattgtagccgtgttaacaattcgaacggtgtgtgctggtcgtcgatttcagttgcaacattaccgctcacatattcactaaagacttgataccgcgtcgccgttttttgaaattgataccagttccccctgatacgccgcagtaattgcccgcgttgtgcctgctgattgagccaccgcaattcctgctctgagcctttgaccgccatttgataacgccacatatactcacttccccgttaaattaacccgttacaatcccgcctgctcacaaatctgattcaataattgcagtcgttttcgttcagccgccaaaaccgattcaccactccccgtgatttcataggtatgcacgtcattttcgtcgactcgttccgtcattaaataatccttcgtcatggcatgcaaattcgtaaataaggttcctaatcctagctgtagttgattattggtcatttcagcgatttttgccggaatcgcttcactggtaatcggctggcgaacactgactaacactaagaacgctgcttccgtcattggttcatacttatcaattaatcgttgataaaagttagctggcatattttcatcccccttaatcagattattgaagcgctttctttttcaatcaatttaattatgggccaccgttttcttgaatgcaactccccagaataatttccacaaaaaatcggtagccactgattaacgcggttaccgattgctttaatgaatttgaacatccgctacgaccgtacttgtctcgtatgggaaatgtgattcggagacttcaaagggttgaccatcatccatgtaactaatctgattaattaccaacacgggatcattcagagtcgcgcccattgcggcaacgtcatcagccgtcactcgggctgccgagataatacggtgtgaacccgcgattttcttgccactatgttgctctaaataaccgtagaccgagccttcgaggacttgcttcgtcaacgtcacgatactcgttggcataatcgtatgctcatacgcccacaccttgccatcaacgtagcgggtccgccgaataacgtacaccggatccatctcatcgattaacaactgttccgcttcccgcttagtaggcaagcgagcttgtaattccaacaccttactcgtcacctttttaccggcattcgtttgcgttgttcccagtggcttgtctaccagcgtttcttggcgccgttcagtcaagccaaagtccttgcgaacaaaggtccccgcgccacgcttggagtaaaccatcccttcaataatcagtaattgaatggctttgtgaatcgtaattcgtgtcgtatcaaaagtttcagctaatttattctggtcaggcatcaattcgcccggcgtatatttaccggatttaatgtcttgtcgcagactatccgcaatcgtttcatacttataagccaaactactcacatccccttcatcatttggtcttgtcaactagtttaccccttttagtagctaattgaaatcatttgtatatacttttattggctttgtttaattaacgaccaatccaactaatcatcagcatccgtcactgaccgtatagccgaatgaatcagcgcatttgaccaccatttaatcagctgttcccgattttcccgttcaatctcgatgtaaccggctacatccgttcggttttacttgcacccccacagactttggcgtatgctttaatagttaaattcagattagaaaaagctgtgacaagatgagtaagctaattctcgtgcttagagagtcgtatttttggtgcaaaacgatgacgtggttagttgaagatggtcttgaagaagctactggggccatctcagtcggagcgatccgttacgatcatgataagtccctgtgggaaaatctcggtggtaacacgcaaacgcgtcctagaaagcattcgcttttaggcgcgtttttatttgaaacaaaataatttttgagcgcactaatctaaagcactcgaaagtgttgaaaaaaactagtatactaaagctactagctagtatttaagtttgtgggatcaacgtaattgccttgcgttggtcctttttatagtctacataagttgtgccttcatcaatcatgacgtagataattcgtaataatttatgagccagtgcgactagcgctttttgcgcggtcatgcgaccgtgcaatcgccaaaagtagtcttttaaaccggtttccttggactgtttggcggcaagcgccgcgcttaccatggctgatttgagataaacattgccatgtaagatatgagcaccatgtttgataccggcagattcataattccccggacagagaccggcccaagaagctaaatgatgagcatctggaaatggacttacatctgacccaacttcggcaatgattatctgagcaatccgttgactgataccaggaatgtcttgtaggcgaagatacaaatcattaaattccataatttgttcatcaatttgagcatccagttcagccaatacccgcctaaaatcagcgagtagttccatattcaagcccaacaatctccgatcgttgcgtggcagaatgccatccatcgcagcaaataattgttcaacactagcctttatgcgggtgtggcgacattttgtgatggcctgtaaagtgatgacttcaccatctatgagtaacttcagcagtttaaggccagttccgttaaaaatatcggaaatataggtcgttaatttaatgtttgagcgttgtaaaagattatggacttcatttttggttgcggtcatagattgggtaatcttcttacgtaacctagttgattcgcgtaatgcttgaatcgactttggcgggacaaaacttgcggaaactaagccgtaacgcgccaattcggatagccattcggaatccttttgatcagtttttttaccaggaatgtttttaacaattcgcgggttacacaggatcatcttgaaaccgaagggttccaagatttgccaaaccggtcgccaatactgaccggtactttccattagaacttgttcaacatggcgttgcttaagccattcaccgcaatctttaagccgacaagtaatggtttcaaaacgtttcgagattttcttaggcttggcgttagccaagcccaccaatatagaaactgtaatctgtttttgatggacatcaataccagcaacactttcagcaacgacttccataaaactcacctcctaataatcttgaaagcagtaccttcagtcattgagggttgaaattttatttacgtgtacgaaacgacaattgattaatctcatgaactgaaagccatcggttttttatacgggctaaagcgagcaccaataagcacacgatgaacacgaaaccgccttcgcagtcattataactgagaaggcggttgtttcatatcatgattacgagggtagagcgaagcggcgccctcagatagttttttatgaccataactgatctgaaattaacgcctgttcgcttttattaatggttattagaacttattcattctcaatacttaaggagtgttacactatgcaaaacaagcaatccaattcaattcgtaccgtcgtggctaccgggatcggcgccgccgttatttttgttctcatgaaatttgtcgccattccaacgggtgtgccgaatacccaggttaacgtcgcgatggggtttttagccttactaggagccatctttggtcccgttgcagctggtttagccgtgttcatcggtcacgccttaaacgacttcgtaacttatggttcgccttggtggacctgggtcatcgttgatggtctgattggggttgccttcggactagctaaaaatcggctcaagattgaaaatggcgtactaggaacggcaaaattagtctggtttaacatttaccaaatcatcgtcaactttattggttgggtgcttttagcaccaactggtgatattattatttatcatgaaccggccaacaaagtttaccttcaaggtgtcattacttggatcgccgattccatctcagttgccatcattgggaccatcctactagtcttgtacgcccggacgcggacccaacgtgggagcttaacaaaggaacgttaataacatgagcgcacccatcattagctttaaaaatttttcttttcaatataatagccaaacggaaccaactttacgtgatattaatctggatatttaccccggtgaaaaagtgttgattgctggaccttctggctccggtaaatctacattaggccggtgtttgaacggcttgattccgcagtcctatccaggaacagtgacgggccaagcaaggattgctggtcaaaccattactgagagctccatttttgcattatcccaagacgtcggtacggtactgcaagatcctgatagtcagttcgtcggtttgactgtcgtcgaagatatggctttctcattggaaaatgatcagcagacccaaccggccatgcgacaagcaactgaacagtgggcccaaactttagacctccaggacttattgactcaccgcccgcaggaattatctggtgggcaaaagcaacgggtcgccatggctggtgttctgatcgacaatagtaaaatcctattatttgatgaaccgctagcgagtcttgatccggcatcgggtaaagcctcgatggcactcattgatcagctgactcatacgcaggacctgaccgtcatcattattgagcaccgcattgaggacgtgttacagcaaccaatcgaccggctgattgtcatgcaagacggcgcgatcgtcgctaacgaccggccggaaacgattttgcggcaatcactcatgactcaactcgggctacgcgaaccattatacctttcagcgctcaaactagccggtgttgatctagcaacttgccaacacttggataacctccaagccttacaagtacccgacctcaccgcgacgttgcaaaactggaccgccggcgtacaactacagtcgcccaccgttcatgaccaaccgttactcgcaattgagcatctgacattcgggtacgatcccgccaaaccaatcatcaacgatatcaccgtcacacttcatcagggtgaaatgattagtctagtgggtcaaaacgggactggtaagtcaacattaagcaatctgattactgggtttttgatgccacagtccggcaaaatgcgatttaacggtcattccctagctgaccaatcagtcaaagaacgtgccgaccaaattggttatatccttcaggaccccaatcaaatgatctctaaaacgatgatttttgatgaagttgctgccggtttggtcctccgaggtgtcgctgacgatgaagtaaagcgccgggtccaggccgttctgaaggtctgtggtctctatgagtttcgccactggcctatttctgcgctcagtttcggtcaaaagaaacgggtcacgattgcggccatcctcgtattagaaccagccatgctaattcttgatgagcctactgcgggccaagacttgcaacactatactgaaatgatgaccttcttaactaagatcaatcaggaacaacacatgacgattatgttgatcacgcatgatatgcacctaatgctagaatacacggatcgcacgattgtgttgggccacggcaacattttgatggatgctcgcccagccgatgtgttgaccaacgcatccattattcagcaagcttccttagccaagacaagtttatacaccctggcggaagcgcaccatttaaacccgacagaattcgtcgcaaaatttgttcaggctgaacgggaggcgcgctaagatgcaacatgaattattgatcgggtacaacgaccgtcatacttttttaaaccggcttagcggtagcactaaactactctgctttgttggcttatcagttatcgggatgatgacttacgacacgcgttacttaatcgaggtgatgattttttcactgattctattccgcttttcaaaaattcattaccgcgatatcgcgttcgtgcttaacgttattattggtttttccgttttaaacttagtgatggtgtacgtctttgcgcctcattacggcgtctcgatttatggtaccgaacacttactactgggatctgctgatcactattttaacttgacagccgaacaacttttttatgaatttaatttgttattaaagtacacgtttgccgtgccactcgccctgatttttctcatgacgactaatcccagcgaatttgctgcgagtctcaataagattggtatttcctatcgtatcagctattccgtagcgattacactacgttacattccagacgttcaagctgattaccgtactatcagtctggcacaacaggctcgggggtttgaaatgtcgaaaaaagcgcattttatgacccgtattcgtggcggcatccaaattctgcttccattgattttttcaagcttagatcgaatcgaaaccattagtcaggcgatggaattgcggcgcttcggtaagggaaaacggcgcacatggtacatggcccaacgctttaaacgtaacgactatctggcgttaacgttagttgctctgctgatcatcctcggcatcgccctctttaaggtcaacggtggccgtttctggaatccgtttaaggcataacgttgcatcataattttccaaaaaacttcgtcgaccatgcttatcgatgaagttttttgtttgcatctacctatcaagcctcacctgacttaacaacagcaacaatccccttattccacacgcaccatcctgttatgccaagattaactaaaaccagcgactttaaaattgaaaaaacaaatttcaaccgctaaactgaaactagatcttacaaaaagtaagcaaaactagcttgaaaggatgttttattgtgactagttttaacgaaccactcaaattcaaatctggcgttacactacgcaaccgcctaatgatgtcgcccatgacgacgactcaaagcttttacaatggtagtatcacccatgacgaaatcgactactacacacaacgagctactggcttaggtgccgtgattacgggtgctgccaacgtcgaagatctcggtaagggttggcatggcgagcttagtatcgcgcatgacacgatgctgcccggtctaagtgcacttgctcatggcattcaaagtcaaggtgccaaagctatcgttcaaatcttccacgccggtcgaatgacgcatcgagccgtcttaaatggcgaacagattgtctctgccagtgccgttgcggcccttcgtgacgatgcggagaccccacgcgcaatgtcgattgacgagatccacgcaacgattgcggcattcggtgaagcaactcggcgcgcgattcaagccggctttgatgggattgaattacacggtgccaatacctatttgatccaacagttcttctcaccacatagtaatcaccgcaccgatgaatacggtggtcgcacgccacaagaacggttccgctttattgatgaattattaaaggccgtctttgcagctgttgaccaatatgcggaccggcccttcatcgttggctatcgtttctcaccagaagaattcgaagaaccaggtattcgttttgaagataccctttggttactctcacaactacgggaaagtcgattagattacgttcatgtctcactcaacaactatgaccgtgtttcacgagacccgcagtatcaagataaatccatcatgacctatgtgcatgaagcgttacaaggtaaattgccgctagttggtgttggtggcgtccggacccgcgacgatgtcaagactgtgttacaaactgccgaactagtcgcagtgggccaacaattactttatgatccaacttgggccgtaaaactcgctaaaaacgctgacgacaccatggttacggcaccatttgaagaagccgttgaggtcacaccacttagccggccgctgtatgaatttgcagcctcgcgctatcacagcgtcattaatagttaacctgtcagccgaattaaaaacgtccactgaaaaaataagtgggcgtttttatgtttcacgtgaaacatttagactttcaataaccaattcagttgttgtaacgcacgctgatggtcaccttgatattgacgcgcaatatagtaataggctaacgtttcatgggccgttgcttgccggtcgacgggcaattgatactgttggtcaaagacctgttcaaatgcttctaatgtcggcgcagctggctgttcacgcaaacaaaactgtcgtaattccgatctagtcatccggtcacgggcaatcggttggcggtcttcatgcgcagccaaacgttgctgtagtgctgcttgcataccggcatccgcattgtccgcaagccactgttgagtttgtggcattgtcgtttgcatggctaattgttcaaaccaagccagcgacaatgattggccccaccgggtcgtcaataagtgctcccaatccgcacgttgggtcgcctgctgatgatactgccagccccaacaactattgaagacatcgtcataaaaacgcgtcgtttgttgttcatctagctgttgagtcacctgattaagtgcggcaacgaactgattatcaagcatggctaggcgccgaacttgaatcttcccagtctgtcgatattcagtcaccatttgcccgaattgataagagttcaccaaagggcgttcggtcgctggtggcgtgattttttcaaactgttgcttcgccatcggtcgttccggacgcatcacaataatggccgccagctgctgtaaataacattgataggcgtgactctggcgcaaggtttgctcggccttcacagcactttgctgcgcttgtgcctggcgttgttgttgattagtcacaattgcttgacgggccgcccgctcagccgcttcaatcaccgtttgttcatcatggactaaccgctgataggtttgttcagcgggctttagttcctgtaatggtagctgcttggtacgacgttttaggtacgtcgtgacggtttgcgtcgttgtttgtcgcaacttgcgcgcttggggcgcttgctcagccggtaattgtggtagccacggctgagcaaacatgatcgttggcactgttggtacagcggtagtcagcgtctgatactgggccaccgcataaaagttatcttctgttgtaatcaccatcaagtaacgcgtttcggcgttcatgaactttttgacgcattcagaaccgacaatcaactcacgatgattatgcttgttttgaacatggtactcataacgaaccggcttatgacacaattcgcaatgatgccatgcttgtcggctttcattcgggttaacaacgtacggcagactcgccaaaagttgccactcatgactacagtcggtcaaccactgtgcatgatcttgtaaaatcaagttacggacagtcggtttcaagaaatcactgtcagcctttaccgttacgtgtgcgcgtaataacgcactaatttgttggagcgtggtccgccgtcgagctcgttcacttaacagaaagaaacgattttcagcgggggttattaaagttgttgctgccggcaatgccgcccacccctttcagtaaaaataccgttctagcataccataactttcccattcagtgcgaacgttagttctaaaatctcggtcactctcattaacccaacggttactcccaccgcggttcgtttgttatcaagcctttattgattgcattcaaattcacccactttttgataattttattgatattacgattgttgcaaagcagtcaaggtgctaaactatcttcgaatcaaaaaagattcactttaagggggattttgaaatgaaaaaattaacatcagtcgttgcaacacttgctttggcattaccattggctgccagcccgtttgccatgaccaccacggctaatgccgccacggtaaccccaaaagccactacccatgcactcactaaagcgacccacttccccgccatcacaatgcacgcgaaggccgccacgactttgaatacaattcactttgccgccgatcgggcaatcgcctttgttagcccggccaaagcaaaactcagcactaaaaagacttacacggtaactaagacgattactttagcaaccggcaagcatacgtcggccacatattatctcattagcgaacacggtaaggccctcggctgggctaaagccaccacgatgattaaagggaacgccccgaccgctaaattaaaagcgaccaagaaaaccccgaagactaagttgacaattactaagaagaccaccaagcaggctggacctaaagccaccagtgctaagaaagcaacgcctaaaatcaaagcctctaaaaaggtaatcaaattgacaaagcagacgaccaccaaggcaaaatcaacgaagctaacgatcaagcaccctaaggcaagtatcaaaccaactaaaaaggtaacgactctcgccactaaaaaaacgttagcccaaccaacgaaaactaagaagatggcaccacaattaatcaaaaagaccgccaagcaaaacgctaaaaaggcacccaaacttgcaaccaaaaagcatctcacggtcaaaaccactactaaacacacaccgtctaaattaacacctaaagcagctgctaaaatttgatcaaccactaaattgcttagcaacctgatcctgttaatgacggcgtctcaacgagccgttactactgatcgtgatgcacactaaaacgctccctatgaaagtcatctttcatggggagcgtttttacatcatgccatcatcagcattaaccactgacaggccagcatttaattaatcaaacatcttcttagttgccttgagcaaggtctttggatccttatcgtaccgtggtgtcttgaccaagttatccattgggaccccagcaaagtgataagcggcaatctcaccagagcggaccgcactctgttccgtgaagatcatctggtatggttgttccgcaaattcacccgtaaaggctaggttcgttgagtgctttggtaagacttctggccgatcagacttagcccggttattaaagagtgcggaagcatatggcatgtataccggaatattgttcacgatactgtctaaaatttccttttccttgtccttaatattgcctggacccggatctactttggaaagttgaccaattaattcttgagccatttccttacccgtcatcttgatatacggcttgttaacaaactcaccttgacgccgtggatacaagaagtagccccacagaactgtttcgtttggttgctgtgtcgtaaagtgtggttggtggtgcaccacgatcgacatattaacatccttttggttcaacggcgtaattggcgtagttgataagaaggagttcaacgcattcccgggttcctgggtggtgatccgaacgatttcatttaagaataaatgattcttagtcgtcaacgtgaagctgacccattcgctagcattccgatcgttgaagaacttatctggcgtccctaagttatagaaccgctcagtagccttcttccacaaactagcactaacaccataatccatattttcaggagcaggcgtgttgtaatcacccatcgttgcagaatcggtaattgaaccgttagtgaagatcaccgctgtgtcctcatcaacttcaacttcttccgtttcgccagtctgcgcatcctcaatgactaagccagtcaccgtaatttcgtcttgcattggcgtgtctttaaattgccaatccttaacaatcttattatcaatgaaagtcacaccttgcccttgcaagtacttaattaatggcaaaatcatgctttcgaattgattgtaacgcgtccggttgacaccaactaagtgttcaatttgtgtaaattcataaatcatttgatgcatgtaacgccgcagttcttgagcagagctttgcgttctaaaggcaaaggttgtttcccacatataccagaaattcgtttggaacatatgcggatcatccttgaagtactcagcaatcgaaacgttgtcgagcttcgtttcttcactatctggcatcatgatcaacttagtcagcaaagtccgatccttattattgaatcctaacttaccagcattaataatgcctttaccaccctgcatcaagcgggcaatatcatacgtccgatgtttcgcatcaaaatcacgcgtatcttcggccgccgtcatccccggttcagttaccgatggaatccggtccaataaatccattaagtcaacgtacgtccggtaattcagcatccgaccaccccgggcaacatacccagtcgtgttagccatcggatgattcttattccaatactcattggtaaaatcagtcgtggcaccaccatcattcgcaccgtgcatatcaacaccatagaatgtgatgtccttaccatcccaatgaccatcttgaatcaagtagaccgccgcagccatatttgatagcccggcaccaatcataattgctttacttttaaccataaataacgcccccaaaataggtaattaggttctgataacgcttacaagtacattatacaacttggatagtgattgtctagtttgaactgaacttttttgttttcttgccgctttcttaatatttgcgctagtcaaccaatttctgcccatagcgtaacaccatttgatgacttttctccaattaaacacattgcctttaacaaatattacattttttcaagcggctcattcccaccacaagttctgccatttatgtatgcaaaaagcgagccttgacaaatgcagacggctcgctttttattttgactaaccgttcaaattaacgaatagttcctgtatattgaaaatcatcggcagtgggatcttgtagaaaagccttcaaatcagtcatgttctcaataaccgctttgccggacttagccagcatcacattaaacgtgccatcagctaatgtttcaccatagtaagcaacggggatatctaaaccatatgctgttccagtttcccaaatagttcccgtgtcaaagccatcaaccacggcgacaactaacttggcccgttttaaatggtccacattgtccgtaaataccgcgtttcgatcagcttcggtcgcatccggcgtcaaatcgatgccgtctagccgtggactgtaataagtcaattctaactcgtccattaatttttcgatcttagctagccgttctggttggccctcagtaaaccaaggtcctgctaaataaattgttggctcatcactcatcaaacgcgtactcatttgctcaatcctctttctcattcaatgtttattcattttaaccgtcaaccccatgaatttcaagcgtcgtttagctcgttttaggcaaacaaaaaggtcgggaattcccgacctaaatactcatttaacacttaattgacttaatccattaaaatcggccgttgttaaatcaacgttggcggctgccacattgtcccgtaaatgctcaatagaacttgttcctggaatcggtatgatattatcagaccgcttcaatagccaagccaaggcaatttgcgctgggctcacctgatacttttgggccatcgtgctgaggacactcccagcctgagccagttcacccgttgctaatgggaaccatggcagaaaagccatcttttgtgaggccgcgtagtcaacaacgtcatcatcaccgtgattggcgacattatagagattctcaatggcatcaatcttagcgacttgctgcgcttccttgatttgatcaacagttacttgactcagaccgatatgcttgattttaccttcatcctgaagctttttgagttcaccaacttgatccgcaatcgagtaatgagggtcaattcgatgtaagaatactaggtcttcatggtcaatccccagtgtcatcattgaaacttctacttgctgacgcagataccgtggctcaccaagtggcgtccacacattcggtccttgccgcgtttgaccgaccttatcagaaatgaagatctgatcacgattagcggcatccttcaagcccgccgctaagtaccggtcagcaaaccatggaccgtatgaatcagccgtatcaaagaaattaacgccatattccagtgctttcttaactaccttgaccccattttcaggatcagcgtatggtccccatgtcccaggacccgttaactgcatgacgccataacccatccggttaactttgaattgatcatcaaacgcgtaagtacccgcgttagctgcattaatcgttgtcatcaaatcgctccttatcgtttattaattatgttcagtttactcctatcgacccaagtgcggtcaaacattttgttcgttaaccttgggttaggttgtgcatgtatgaaccagccgcatctggcaagtcgtttaaggcttgcatatcggccacactaattgcgaagtccaattgcgtattcgcctcaatatgggctggattaacagccttgggcaatggcaagaccccattttgcaaaacgaagcgtaacgctaactgcgccacactgacgccgtatttatcggcataggcctgtacttgcggattatcgaggaccccgcccgtcgctaacggcgagtatgcttctacaagcatggcatgttcctcagaaaacttggtgatcttaggttccgtgaagcccaagtaatattgaatttgattgaccattggtggtatcgtcgcctggttaagaatattcttcaaatcccgaacagcaaagttagagacaccaatcgctttcgcccggccactttgataaatagcttccattgcctgccaaacatcgaggttagcttcatcgtaaactcgaccgacttgcccccatggccaaggtgcgtgtaccaaatagagatccacgtagtctaaacccaaatttttcagtgagcgatcgaaatcatttagtgcaccttgatatgacttcgtttcggccggtaatttagtcgtcacaaagatttgctcacgtggaatgccagaatcacgaattgcctggccaacgctagcttcattttgataggccagtgcagtatcaatatgccggtatcccgctgctaaggccgcacgaacggcttgatacgttgcctcaccaccaggtatctgccaagttccgaatgcgactttgggaatgttgacaccatttgctagttgatacatcgttgttaacactgtcatcttatttttgctcctttactggttttgactgtcgttgctgagtgggatcacctacaaggcttgccccgatgatcgccacgccgacgaccgttagaatttgaataaccgccatattactgtggcctccttaattgaatagagattagtgtaatcccttagagtaactctaaggcaaagataaagtttcaaaaaaagaacgaaattgacttgggccaatctcgttctgcattattgtgatattaattactcataaatcgttgcatgctggaaaatgatgctgccggataatgctagtaacgcggaaagaatgatagctaaccagagtactggtccccagcctaattgaccgcctaaccagccgaatagtacgggccccactgcagctaacaaatagcccgcggattgggccataccagataagtcagccgtttcaaacccattggtcgttttttgcgtaaagaagacgactgccaaactgaaggctgctccagagcctaatcctagtaagacgcaggacagtgctgccacccaaaaattcgttccggaaagtaagataccaccaattcccgcaataaaaccgacacctaccaccataatcattgcccaaacgccgcgccgatgaccagaagtcgctggcactaaatatgacatcggtaggccgctcaattgcatgaccgtaactaaattgccagccacaatcaaggagaagccatgggcaacaaataccgttggtaaccaagtcagtaatgaatagtagactagtgcttgcaagccgaaaaaggccgtaacgacccacgctaacggccgccgccaaacactcccgtgagttgccgttgactgcccatcactcgcggtcatcgcaactgttggtgcgcgatgattgtatttcaagtttggcaaccagacaaccaaattaattagtccaatcaccgatagcaccgccatcgttagtggtaacgaccagtgtgccgccaacactcccgaaagtcccgttcccagtgaaccgactaatagcattgagagcgtgtattgactagttgcgactggaatcttcgtcggaaaattatctttaataatcgctggaatcaagacattgccaccgtccgcgccaatcccgactagtaacgtcccaatgaaaagggcagcaatcgttgggatgacccgcagataactcccaacggctagaaagatcaacatgacataaattgtcagttcgttgccaaatcgccgcccccaatgtgcaatcaatggggacataatggcaaacgtcaataatgggatcgtggtcagtaatcccgccatcgagctcggcaaacccagtgtccgtttcaaagaactgattaatcccggcatcattgtaattggtaaacgcatattcgttgccgctaacatcattccaagtgttaaatagcggctatgttgatgtgttgtggtcataagtagttgacatcttctttccaagattttagttcgataattgtcgaactaaaaagcaaaaaaactaaagcgttgctaagaaccccggtaaaaaccggtcaaaggtcgctaattgtaaggatagatacttcgtctgtgcctttcgtcgcgtattggtgagacccactaaccgcaaggtcttaaagtgataagagacggttgacttgctgatatttaattgcgcccccacttcgctgcaagtcatttcccgttgtgcttgatagagcacccggataatccgtaatcggttagcatcggccagtgctttgaaaatcgccactcgttgctgatcagcctgatcttgtttacttatttcgatattcatgaaactaacaatacactgaattaacatcatgttcaaggacaagtaacaaaaaaggcagctagccaatttaatagactaactaccaaacacctaggaaactgcccgtttgccgttcttccaaatatcaggaactaaccacaaaattaaacctaggttaattaacaaaagtaacgccgtcataatgaataccgcgttgtaattgaaccaaccagccaccaaaccaccgagcaaggcgccgaacatattgccaatagcttgaaaagattgattatagctaaaaatcgttgaggtaagatgtactggcgtattcttagtcaaaaccgtttgaatctctggatatagtgcgccatcggaaatcccaatggcaaaccgcaaaataccgagggccacgacgctcgtaacaatgccttgtgggaaatacataatcaccgcaaaaatatagccaaataacaataccttaccagaaccgtgctgatcaccataacgtccaaggcgcggtgctgaaaagatgtttgaaatacccggtaaagctgcgataattccggccacaaccgtaatcgggccacggtaatgcatcaattcacgaacgtataaactaatgattggtgcaatcgaggcgtttccaaattggacgatggccgtcgaacataacatcacaataatcaagcgcggattttgaaacgctgctaaaggattgcgactgtcacctggttcacgatgatgtgcgactggtttgaagtgttcctgtacaaagaacagactcaacaaaaacgccaccattaataatccggccgtaataaaaaacgtgtttcgaatcgaaaacaattgggctagcaagcccccaatcactgggccaaacaattgaccactaacggcaccagtgatcaaagtgctcaacgcccgtccactatatttacgtggcgtttgggacgcgactaaggcttgggcattagaaataaagcccgcaaacacaccttgtagcgcgcgcaaggcaactagttgccagacattcgttacaaaacccattaaccccatcgcaactgccatccctagggacgcgcgcaatagcatgatcttacgaccttttttatcagcaatgatgccccacagtggtgccgaaattgctgaaatcgcgtaatcagctgcaaaagctaacccgctataaaatgtaatctgggccttcgtgaaatcacccaactgactaacaaataatgaaagaaatggcataatttcgctaaatgccattcccgcaacgaacgtacaaaaccataaaacaatcaaattacgatgccatggtccgcgttcacgttctgcgtcatccacgctcgtcatctccatatctaactgacactaattttcagtaagtaatataccgttaattagcttatcatatttagcgaccaccagtgacaattatttcccgggaaattttttgtcatatttcctgaccagttagcccgtttagttgaccaagtagcaataagcactagtgtcaagccgcatttttcactacaataagcttatcaaaatcgctatttaaggggggaatcagcgatgcacgtccagttaaccatctctgaaacgattcatcaatgtttttcaagatcgctcgctcattaagctgccacttcaatcggtgtcacgtttttacactgccaataaacgactttattgtgaaacaaccaccggtgcttacctcgttcacagccacttacacactttaatggaccaactgccaccccaccaatttctacgtatttctagtagtgaaattgtgcgaatcgcctgtgttaaaaattttaccttaaccaaatggggtagctttcaagtcaacctaacaaccggcacaacaacatacgcatcacgacgctatacccaacaaattagaaaggcggcacaattatgaaaagactttggcacacccttttgattggcgccatcggaggcatcgttatcggctacttaatggccttggggttctcaaccttctttaataccacctatttatttccttctaatcccacttttgtcagccactggccctcgcccttagccgccacccagctttcgacattattgtggattctgattggtgaagtttgggcattcagtagctggctattcgaaattgaaacgtggtcgattacgaaacaaaccattgctcattgtctgtgttcttacctagggatgaccccacttgcgattctctgtggctgatttccattaaacgttcgctggtttggcttctataccttggtttacaccggagcctatatcggtctatggttaattgaaatggcactcgcccgcatcaaagtcatccagctaaaccaacagcttaccaaccaccggtcataattcataccgattgttgatgtcaaaaacggcccaccgatttgattatcggtgggccgctcacttgttactgatgatttaatgatttaattattgaatttcgatttgaccgtcattcgcgctcggctgggtcttaggtaacgtaatcgttaagacaccgtcagcttgggatgccgtaattttatccgccgcaacgtttggtaacatatactgccgttgcaaggtgccagtatgacgctcattcatcacaatgttttggtcttgatcttcatgatccacaaagctatctttttgaaccttgatagacaacacattgtcacgataatccaacttcacatcttgcttatcaataccagggacatcaaccttcacttgatactgatcatcagtttcgttaatgtcggtcttcaatacttgatccatgttttctaatggtgcccagaaggaacgtgccatccgttcaaacggatccaacatgccgaaatcgttccgattcattaaagtattagccatactaacaatcccctttcaaaatttcacttggctattaatactggtcagtaattcaaatccttgtttgacctttcctgaccttcgatatatatactaacaccattttgtgggaatgcaacaatttagcactcatttaaccggagtgctaaattttaatttcacgaatccgtcgcattaggctaacaaagcgtctcagttccgcgtcagaatagtcatcagcaatggcttgtgctttagcagcaatggccgcgtccagttgcgtgtgtaaatcagcgactgcttcgcccagcgtcgtcaatcgcacgagaatttctttgttattggtcaaatcccgatatttcgtggccaatttcaatcgggataatttagtcaaaccgcgagaaatcgtcgcctgtgaaagttccgttggtgccggtagcgacttagctcgactggcaccacgccgtcccagatacgcaataattttaatatccgtcgtcgatagttgttttaatgccgcttgtaattgcggatcagtcgtttgttgcatggcccagcgtttttcttgatcatcaacgctatcctgcgtcaaaaattgatttaattccgtcatcaactgactaactaatggtgttgtcatttaaatatctcctttttaattcaagtgaataaatacttgcataccaatattattaagtctatactatcattttgtattcattagaatcaataaaaatatctggaggtcccactatgtttaaaattgcaatcatcttagggagtacccggtcacaggctaacggccgcgctttatttaaccatctaaaattaatcattgaccaattaccgactcattctacgattcactaccaatttttagatttggccaactatcagcttccccttttcgatgaacccgagccaccgatggcgaacccgcaccgcgagctacctgctaaccagcagcaatggctcaccgatatggctagtgcggacggttacattatcctgacacccgaatacaatcacgcgatgccagctggattgaaaaacgccttcgattttttggcattcgaaggcgcccgtaaaccggctaagattatctcatattctgacaatatgcgcggcggtcaatttggggcggccgcactagttccagttctccaacgattaggaatggtcgtcctccctaaaccaacgcccattggtaacgtaccacaaacccttcaaagtaacggtcactttatcgataacgcgcccctgagcaaacgctacgatcgtgcacttcaccaagctttgaccgaaatcacctactataccacggttcttaccactacgccgtttccaaccgattaaattagtagcgttattgaatcaaacctgctacattatagttagcattattaagggggaattaacttatgaagatcgatattcatcgttccgcaacggaccgggtgattgccggtgtcattggtggaattgccgaacattttaactggaatactaacgttacccggctattatttgttgttttagcaattacacccatgttccctggtatcatcgcttacctgattctctggttattaatgaaggaccccatcaaggattaaccactattaacgaacagtcatcgactgctcgttttttattcgctaatatgcggccaaactttccgtagctagttcaatggcaacaagaacaccgcccgcaccccaatgtcgcggatcatagtgctctagttgtgctaaggtgtctgccgtatatagtaattgtccaaaggaaacttgccgaaacgccgaacaggcagctaaggccgaacattccatttctacgacttgacaaccctgctgacgagcagctttgactttagacacagtctcacggaagaaagcatccgttgtccacgttttgaccatctgccatggcaggcaagccttcgtcaatgttgtcccgagtacctgtataacccttggatcgagtggcacccaatcagctgctgctaaataatgaaaggacgtcccttcatcacgcaaagccaccgttgggattaataattgttcctctggtagtgctgttaatgcgccgcaactaccaacggctatgacggtacgagcaccaaaatcaatcaacatctctaaatacattgtcgcagctggggaaccaaggggcgcttgcgctactgccaatttttgaccacgataaccgatttgataaacccagctaactttagtaatggtattaaattggcctaaacggtgaccatgataccgagtgacgaattgttgaaaataatcatcaccagaaaatatgtagagtagcttagctggaacagtaaagcggccatccacgtctggccctaccatagccgttggatttggatcatattgcaataacgttaacttatctgtcatcttaagttctccctatttaatttacccaacaattcgaggaaaaccagtcattttcagcgacaaactagccaaaatctgatatattattgcaactaacgcaataatttgtcatgaatttgtcaaatattttaatggcgttcacctagattgttcgtatataatattatttataataacgctaattaagaaaggatgtggcgaaattggcctatttaacacgcaataaacgtcgtgattttacagaacctcaccggtaataactttatttttaaggagcgaattgaatgataaaagatgacaatcagtcgttaacctctaatgaagagcaaaacgacacccagaaccctcccgatgcggataacttatggcagcttgatgaatcagccttagccgcaaagtacgccaccgatcctgagaatggattgagcactgctgaagctgccgaacgtttacaacataacggtcgcaacgaactggagaccaagcgtacgtctcggttcgtccaattcatcaagcagtttaataacagtattatctacattttagccgcagcagcggtcttaacgttcttcatgcaccactattccgattctatcgttattggactggttattattgccaatgccatcattggttatgtccaagaacgccaagctggcaacgcgctagaacggattcgtgaaatgctgatttccaagaatttcgtcatccgtgatggaaaaaaactggaaattgacgcccgcgaattagtcgttggtgacttagtcaacttagaagccggtgacgcggttcctgccgatatgcgcttgatctcagcggataactttaacgtccaagaatccgtgctgacaggggagactaatcccgtggagaaacaagaagaaccgatgactgagaccacgccagctttggctgaccgtaagaatatggtttacgcgtcaaccgcggtgactagcggttcggccgtcggaatcgtaacggctaccgccgaagataccgaaatcggtcatatccagcagtctgttagtgacgtcaaacaaaccactaccccactgatgcgtaatctgaactcactggggtttggcttatccatcgccatcgtggtggcggccgtcctattattcctattaggaatggtcatggatacctatagtttgccaactttactaattgcggttattacgatggtcgttggttctatgccagaaggactgcccgctagcacctcggtggtcttagccatgggaacccggcagatgacgaagaaaaacgtcattgtcaagtcactacccgccgtggaaactttaggtgccgtagatatcgttaacaccgataagactgggacgttgacgaaaaatgaaatgacggtcactaaggtcgtgacgcctgagcatacgtttgatgtgacgggggtcggttatgatgataatggtggcgttaacttcgatggccatctcaagctcaatggcaacaaagtcgactggcaccaagataacgcgatggaatggctcgttaagattgccggccaaacgaccgacgccgagctacacttcgaaaacaatcgctgggaactgactggtgaaccaaccgatggtgccttgacgacgctgtatcgtaaaatgactggtcatgatcctgaggttgaagaagtcgactcgctaccattcgattccgccttccgtttttctgctcgcctggccgacttagatggtcaacgcttactaatggtcaagggctcacccgcgactgtcctgcgtttaactgaccaagctaaccaaacggcatactgggatgacgccatggacgacttaaccgccgatggtttgcgcgtggtggcgctggcttaccaagaagtcgatgatgacgtgactaccattgatgcacaagccattggtgggctgcatttagctggcttagtcggaatcattgacccgcctcgtgaagaagcggctaccgcgatcgccgaattacggcaagcgggcgtgcaagttaaaatgattacgggggaccaccctgatacggcgatggcaattgccaacaagttgaacttggccgccaatgtcaaagcgattactggtcccgaaatcgacgcgatggacgatcagcagttacaagcacacatcgatgattataacgtcttcgcacgggcaacaccgaataacaaattacggattgttcgtgcccaacaggccaataatcacgtcgtttcgatgactggcgatggggtcaacgacgccccggccctcaagcaagccgatattggggttgctatgggaatcaaggggaccgaagttgctaaggaatccgccgatatggtcctggccgatgatgactttgctgatatcgtcgccgccgttcgtgaagggcgccacgtcttcgataacattcgtaagacgattcgcttcttactcccaactagtttcgcggaaggcctcgttgtcatcattagtattttaatgggccacgaacttccgctgtacccgacgcaattactgtggatcaatatggtgtccgcgctgaccatccagtttgcgttcatctttgagccacccgaggccggcatcatggcccggggtccccggaatgttaagtctgggttgttgtcaaaattagattactttgaaatcggctatgtctccttcctaatttctggcttggggatcttcgcctacaactacttgaccgcacttggattaccaaatgtcgtcggtagtaccatgtcactgaacatcatcatctttggtaagattttctacctcttcaacttgcggaatgaccaccccgtcatttccaagtacttcttccaaaataagatggcgttctacatcattggtattctgattctcttacaactgggaatcatttacctaccattcatgcaatccgtcttccatacgactagcatcaacttctggtatggttggggcatcccgattatctgtgggatcgtcgtcttgattgtgaccgaggtcgggaagtttattcggttccgatggatgggaaaagatggcgtgattgattagtaattagtcaataaatcgaaaaggctcaccaacctgttttagttggtgagccttttttagtattgtgaaactgtttttgatgtggccgttattcaagacaacataatatgttacataatacattatgctattctaaacctgcttgatatgactactattcaagacaagcgcgggatcacgtgcaacagcaccatcgttctaaacctatttgatatgactactattcaagactgctatgattgaaaatatccattagagtcggttctaaacctgtttgatatgactactattcaagacgtcaattcgggtcacatgggagcacgtcacgttctaaacctgtttgatatgactactattcaagacatgacctcatgactagggctggctttgcgtgttctaaacctgtttgatatgaatactattcaagaccacagcctggggtgttgaccgctcccagttgttctaaacctgtttgatatgactactattcaagactaaccgtcttcggtactgctggtataagtcgttctaaacctgtttgatatgactactattcaagacgcattatagtcgtcatcttctttctgattggttctaaacctgtttgatatgactactattcaagacagaacataaaacattaagattaacccggccgttctaaacctgtttgatatgactactattcaagacaccgtcacttagatcatatgattatgaactgttctaaacctgtttgatatgactactattcaagacgatggagtataaacaaggaatggtattcaagttctaaacctgtttgatatgactactattcaagacacttgagcagtttactgggctgaaagacgtgttctaaacctgtttgatatgactactattcaagacactagtacatgtactaatttcatatatcctgttctaaacctgtttgatatgactactattcaagactaacgcaatgcgggacgttgataataatacgttctaaacctgtttgatatgactactattcaagacgaataagtgccaacgctgctcgtatggacagttctaaacctgtttgatatgactactattcaagacaactagtcgcgttgatgaaaatgttgatgagttctaaacctgtttgatatgactactattcaagacgcgcttctaattcagatttaacacccggtagttctaaacctgtttgatatgactactattcaagacgcagggatacgccgccgctaagttatccgagttctaaacctgtttgatatgactactattcaagacggcgctgacacccatggcggtcgtggccgcgttctaaacctgtttgatatgactactattcaagactctctttcggctttttcgtcgaactattttgttctaaacctgtttgatatgactactattcaagacttcttcggggctgtataccccggctttagtgttctaaacctgtttgatatgactactattcaagacgtaacaatctaaaacaaattaaacaacagagttctaaacctgtttgatatgactactattcaagaccgatcctgatcccgatccagctcaacctaagttctaaacctgtttgatatgactactattcaagacctcggtaaaagacgtcatttatgatgagttgttctaaacctgtttgatatgactactattcaagaccattgtgttgcgcaaccttaaatttattttgttctaaacctgtttgatatgactactattcaagacacataggaggatttaccatgagtaaacctagttctaaacctgtttgatatgactactattcaagacgatgacgaattcattaaatctgctaaaaacgttctaaacctgtttgatatgactactattcaagactagctcgccggcttcctcggtggccttgtggttctaaacctgtttgatatgactactattcaagactaaccatgcttcgacctcattggtatagtcgttctaaacctgtttgatatgactactattcaagacgtcggacagtaatgctcagaaatccattttgttctaaacctgtttgatatgactactattcaagaccagcattttaacatcatttactcattaattcatatcacgccagtctactaaatcctcgtcaacataataataacaactatttttgaacttttccattcgatttatttctgagtattcgataacaatgacagttgcgcccaaatcatgcactaattgctcaaagctcgcccattgtttttgatctaagtaatggctgatattagtcaacaccagtttttgtttcaagcccagctcaacatgcgtctgaacgagtgcctccagtattgcccttgggtcattcataagctccgtcggaaagtgaataccggtaaacttcaatatttgttctaggctaggcgattcgtcaacatctaacggtaagtctagtaagaagctggcttccattacttgcgaaactactttacgattttcatctaagaccgctacttgccgatcatcagccattaacttgataatttgggtctgcactttctttagaaaaagacggttcaaatcgactgataacatcaagtcaccataccagttgcattggctactcatcgtctgtaattcaaggtcgtcattgcttatacgtacactgtcgattcgatctcgaaagccttggcacacttcggcatacatgttactatttcccaaatcaagaacgttgaccttgccagcatcgatcttgaatggtgggaatggataatatgttatattcatataacaatcgtcctttcagctgaattcaaaacatcattgctaggtgtaccttgaatatagtgcattgcctgatactgcttctcagttactgtcatcgtttgcacttttccacctttgggtgccagtggcgcaatccgcttttccacgaattcggccgctttcttatttacacaaacccggacgtaagttgagtattgcatcatcaaaaagccctcacgcactagagctttgtgaaagtgtcgatatgcacggcgttcttccgacgtatccatgggaacatcaaacatgactattaatcgcatcactcgatacctcatctggtaatttcacctcaatctttaattcttccgtttcaccgctaagatagtgtaagcacgcggcaacatattctgtaatcgcgtggctcacaattgtttggtgcccattaaacccaatttctaagtctaataacgacactagtccaatcttaatatccggtgtgaagtccttaaaccgttgttgactgacccattgatcaacaatcggccgaaaaggctccattaagtctgagccgaggttaaattcgttttcattgttctcatgatgaataccaatgcaggtcagatagccatttaaaacaatctctcgattcaccatggataacagcacggcgtatccgtagttgagtgcagcgttaattgggctaaaatctcgacggtagaactggtcaccaaataacaatgaaaaatatttattagccacaactgcctcccgattagtcacatcattcagttctaacttatccaactcatcaacaagtgtctgggtatcgccaccgacaaagtcaatgacttgaatctggttcaaaatcttactaccaacatttttcgtccatagcgttgcaattcgtgcttcgggccaagtcacctgttgtcgtaccaaatcagctgttcgccgtgtcggataataatcgttggtctcactgattggttccccctgatgatctgtaaaaataactttgacatgagcttccgccagcgcacaaagcgctgcgctagtaatcacagcctgagttgttccgactaacagcaattgaatatcactgattggaaccgcatatttatcagaactcgtctgaactaatatccgattcattgaataagaaactttagcatgttgagtaataatcacgtttcgccatcccataataacagctccttgattaattatatttttcgtgctactattcacttgtatcaagttctaaaccttcttgatatgactactagcgtcaagatcaaacaaggcatttattgccaagtttcaccttttgagtccgtattcggaccactacatatgtaccaagatgtcatccttatcgggatggcatcttttttcgctataaatcttttaatgcaatttttcgctcaaacaaaccagttggtgattgatatataatttcagcatcacccgttaacttaatgccaccagggacttgtaattgaccaaaactagtttttacgcctaaactctttaaatcaccgaacgaggcattcgcatgtaagccaataaacatattggtcaaaattccttgcttccctaaaaccagcttattcttaacaaattgatttttcgcttccagcagctcaatctgatcacgagcagaattaagtatctttttgaacttgttcatctcgtaaagtggaaagtatcggttaacctgggcaagcgttgcgtcaaaaacagtcagtaaattctgatttaattgcacttcagactcattctgcttacctaaaaatgcgcgctgtaaagttaatggtaaatacagctcttgaatgttgtgataatacgtatcagtaccaagtgcgaagcggtgcgtttgacctttaattctatctcgaaccacctgttcaaaccgtaccttcggcaataacacttcatacgtcagcatcttcttgttgttggcagcaatgagcggttcaattactttcgtcaccgcttgcttgtttgtcattccttgttgttccaactgctcaatttgtgtcaccatagttgtaggtacacctacaacttggtactggacatcctttttagtcgatactttcacgatagccatgtaagccagcgtttttcccgtataaccaccataaatagctgtatcgaaggattgttttttccgaattaatcgcttgccattatcacttgccttcaagagagtttgatcaaacattgccccatagttttcggatacctcacgcgtcaccaataatcgcttgtaatcataaagcgtctcaaaatatttaatatcggttaacttatcccacaaaacttcaccagtatcgatatccgtaattggggtatcagtcttagctagttttcggataacattgaaacgtgttaggttaaccggctgtttagcgaacttaccgtagacgaagaatcgttccagcttcggatatcgcttcaacaaataggtgccaatgaaagcagttaaggctgcgtcaaatgcatgatggtagtcattgacctcacgaatcttcggaaaatcaaacgtttgtcgaaattgatgtgtcaagttcgctttaaccgacacaatagcggtggatggatattctgcattaatcagctcttcaactagtttgataacctgacgtgtctcaaccaactgccgattaataaaaccagtcgcgtacttgctgatttcatcaggacgcatcagtaagtggtcaagcttccgtttggtcatcagccccattcggtgcatctctttccacttagcacccatctttttcccaaacttttcactagcaaacgtatcatttttctcacgattgattcgtgcatttgtcagtactcgattatctaatgagtcatctttcaccagagattgtggcaagatgtggtcgatatcatattctgacaatcgatcgatattaatcgcatcaccggtatacaaatcgcggccattttgtaggaaataaagtacgagccgcgtattgaaattagctttgttcttgattttctcttttaattcacgttggacttgatcactgacaatgacctgagctgttccctgataggctgcaacaatttgttttgaccgtgattgtgtccgccgaccagcaacgccaccaccacgagccgcttccacaaatatccagttaggtgtttgaccatgcatcgcatctttaatgtcagctaacaccaccatcacttcgcgaatagccttcttattttgcggtgacgtatataattcattgatggtatcttgaagatccgccgttgttaggttggcctggtttgccgatttaatttgattctcaatggcaggttggcttcgtaattgcatgaaattagcgtttgtctcccacaagccgtccatgattgaacgattattatcatctttgagacctgttaataattttcgtgataattgtccccagccacgatatcgtaattgacctagttgcttaagttgggccgctgtcagccaggaaatctctgtcagtttttgcttaaaaatcgtactatcttcaaaaatagttgaccataaaatgattttttcaatatcagcttgcttacgcacgtctgacatagcttcaggcaacacctgtttcaaatcatgatacgtggataacgaactattgaatactttcggatccgcaagccccgtaattcgtggcgcagtgggaaactctcccgctgcaactaaattgtcttgaatattcttagctgttactcgtttgtgttttttaaacacttggttatatagtcgttgtttttgccggggtgttaattgcccatcatcaactcgaatattattcagctcattgagcaccataaagcgttggtaaatcaagctgcgtgcgggtagcacttcctcaccgatcaaatacgtatccgtcgtctgcatccgctgaatgaaagcggtcgccgaggccacccgatcgaccttatcatcaaaattccatggcgtgattggcccatcagccttacgtaccatccatgcaaaacctgcattggcagttgctgcctgcatttctttagtgatcagcggtccgacataataaggcacccggaaaccgacaagctcatcaagtttgtatggaaacttaccgcgtcgcttgatgaccggattttcttcacccaaccacgggtagtattccttctgattattaataatttgatctagctcattttgttgaacctgataaggaatggctccattctgctttgtccgtaatttaggcatgaattgttcagagtcaatagcttgcttaatttgagctgcccaactattcaaatctacatcggcgtcaacaaattttcccaaggccttttgaaacgcttcttgcgtcacctgtttacttttcacaccatcaatatattgatcgtaggttgcccgaatggcccgcccgcgcttggcgtctgactgagagcgaatatacgctttcaacaacttcaaatcttcgccatggcgtttatacttctcaaccatactctgtgagaaccgtttaccttctggaataagctgtgcaaggttgacgctggcgtataaccgaattacctcatcaataatttgttggcccacttcgctaaaacggtcttcaatgccaggaagtttgtcttgattttcctctaaactaaaggcccaatcctttgcttcagtagcgtcgatgtccgttagagtcagcacatcaatcttggttttatttccaacgagggctttcgcaaattctgttaccactgccttttggcgcttcttttccgcagtagtcgcgccagttaaaactgctaatagtggcataattaatttttggcggtcactacgcgagatatcagttcgtaccaatgtttgtttgatgctgtcaagcaacgctacatcggttgtcaggttcaagttcagctccagatcagcctgactaaacaaatgattcaaagtttcaaagtgctgctgtaaatcaagtgtcccacttcgatacgctgtcgctgcatcattacgcaaaaaattgccgcgatatttgacaatatggtgaatcgctaggtaaatttcacgcacatcaaacttgcggtgctgagtcatcagcgcctcacgtaaatgataaatcgttggataatcatgatagaaatcctgatcactccgatcattaaacaacgttttttcaagaccgttataattaggatcacgaggtgaaatatccgaatatttgcgccgcgcaaagaaattgatatccaccttgctgattggttggtcaaagaattcgcgtagtaatcgcaaccgccatttcacccgtttcagccgacgacgcgttgttcgaaatccccgccggtctgctgcggctgccccttctttaaataaccgtacaccaatcccagtctgccccttaatttttctgacatgaccacttgcatccacaaccgtccagccaaccgagttcgtaccaatatccaagcctacaccgtatggttctttcatttatacatcctccgataaattttagattatgcactcattatcgcgcagttggataatcatttgcaacaagcaaaagttaatcctagcaacgattgtaagcgcagtcttaattattttctttaatattaatgtattaaatatataatctttgtcgtgtcgccaaaattagcgacctattactatagacaaaaatacggtgatgacacaaagaatgttatcaccaccgtactttgaaataactataatttttaaaataataatgcatcaaggaaactcactgaccatgacctagcacgtcgccaaaaattccaacaacgccttattaaatgctgccgactgttccgccatcacgatatgaccagcttccggaatgaccacactctgtcctcgtagtgccatttgagcagtcactgccgcaaagtcgggattgaagaacggtgacttggcgcccgcaatgatcaagaacggtacggtcaattggcggatcacatcccgccaatcctgaaccgcgtggttaaccaacaatggaaacattaatttcgcatcgaacggtgcctgcgcttctactgccttgacgcgcgcatacgtcgcatcatcgatgtgcttaaacgtcgagtgtcccagcggcattctaaaatagtccggaatatcctgccattgaacctgtttgaacccatattgccagtgcggtgtattgatcatctgcggcgtttgatccacgtcgatcagggccttaattcctgtatcaccatacaatgacacgtacgcaaaccaagtcgcggctcccatcgaattaccgagtaaaattggttgttcgagttgtaatttttcaatcaattcatgcgcatccaccgcgcgacgactcatacgtaagcctttcgccgtgtgctcggataaaccttggcaccgcccatctaaattaatgacccggtagcccgcctgaatcagtaccgggatttgagcgcgccaaatatccttagcgccaccaaatcccgtcaaaataacgattggttgcccctggccttcatctgtataatctaactgaacgtgatctgacgtgataaaatgcattccgccatcctcctctttgactattcattcaacatggttgttaaaatcttgtggcgttagcttctgtaatttttctagccattggcgcgttttgtcatccggctcagcttcggaaagtgtattctgggcaattactgtcgaatcaagcaactgagcaaccttttcccaatcaatccccgtcgctgtttgaatactggtttgtagctgtcgtacttgctcagtcgttatttggctcaattgtcgtgaatcaccagttaatgctaatagggcattgactgctaattgctctgataggcaggcctgccacgtcgctggggacagtgcctcagttaacgtaatccgctcacttaacggcacagccggcacttccttgttcagaaaagccgtccagcgtgccatttcctggtcaactaaggcatacccctgccacggtaactgccgattaaaggtctgtaacgtttgcttcgtcaatgccactactgaccacgttgtctgaccattgtcgctcaattctgcttgccctgcggctaaccactgtgccataaaacgttgcatcatctgtcgcatcgccggccgctgttttgccgcttgcgtcaggtggtaacgcacttgcaaaaattcgctaaccatttctggcataatcgcccgcttctcctgagcctgacgtcgttgctttaattgtcgtaaccgtttctgtttactgacttttgcataatgtccttgcttgaccatcgtgccaccacttttcctgataattatattgatattgatattgatacctaattttaacgcaataaaagtccaaaataaaagaggctgtgacataagtctctagaaacaaaacaggtctggaaaaatcttcggatttttccagacctgtttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtgccatgttaaaactggtccttttagcatactgctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgatctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttgaataaacgacgtgataaaatgcgtgaacaccaagcacagcaagcgatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaattggtcacggtagggaccaactttaaaaatcaaaggcgtaagcaaatgggacgagaaaccaaaattcggtttctcgtcccatttgcttatacagaggctagttatgtcacagcctctcttgattacaacgtttcttccttgttaccggcgtatttacggaaataaatcaatgtcatgatgaccagaaatacaacaccgactaaaattgagtagcgcgtttccggattaataaacatgaagaccagtgttaacgcgaggaaggccaacgttaaataatttgaatagggtgataatggcattttaaaaggatggttcgccatcttggctgcgttttgcttacggaacgcaatttgactcactagaataacaaaccacggtaccataccgggcaagacactcgaactgtaaaccatcacgaaaatctcgctagcgtccttgaaaaacattggtaatacaacattcaagacgactccaattagaatcccggtcgcaatcgcaataacggaataaaatggtactccatgacgatttaataaagtcatcttccttggtaactggtgactttccgccaacgtgtaagtcattcgactcgcactataaattccagaatttgttcccgataaggaagccgtaataaccacgaagttgataatcgaagccgcagcggtaatcccaattttggcaaatgtctgtacaaacggtgaaccaatctggcttaacttatcccaggggtaaatgctgacaattacgaagatggcacccacgtaaaagattaaaatccgggcaaccgttgaacgaatcgctttaacgatcgtgctttgtggattttcagcttcaccagctgtgactccaatcaattcaatcccttgatacgacgccaacacaattgctagtgcgaagacaaagcccttcaccccaccagtgaagaaaccaccatgggtccacaggttactgattccaattggatgaccgccgttaccaataccaaaaataatcagacctaaaccggcaataatcatcagaataatcgtcaccactttaataagtgagaaccaggtttccagcgtcccaaacattttaaccgagataaggttggccgcacataagaatacaatggcaattaggcccggaatccaatctggcaagttcggccaccaataccggcagtagccgcctagtgcaatcatttcactcatcccaacaacgacgaactgaaaaatgttgctccaagccgtcaagtatccaaaaacggggtgaatatattcagaagcaaacttggcaaacgaaccggtattcggatcgacatacagcatctcacctagtgcccgcataatcaggtatagaaaggcccctgatacgatgtacgcaattagcactgacggcccggtccacttgatcgttgagctggatcccataaataggcccactccgatcgtgccgcccagtgcaatcatttgcatctggcccgtacttaattttctctgcataaattactctcttttcataaaatcaaagaactcacactatcacggctgacagtatatagcttttatcttagctaaaaaagtgcaccgacgcaaacggatttagtaacacatagtcagtatgtacttgctctaacgcggttcgagcatgcttcgtataaatttatcaacaaacagctttcagtcagaattatcggtataataagggtaactaaactagaaacgaggtttcgtcatggcaaattacattaaagaaattcgggctttggttggtcacaaaccaatcattttgaatacggccgctggtattttagtcaacgatcagcaacaagtcttgctgaaccttcgtaccgatacgcataactggagtttacccggtggctatctagaatacggtgagacgtatgccacggcctgcgtgcgggaatataaggaagatagtggcattgatgtcgaagttgttgatcgcatcggcatctttgataaaggcgagacggcctatcctaacggcgatgtagctcaaacaatcagtgcactctttcttgtaaaacccattggcggccacgttctgacccaagccactgatgaaacactcaaactcgactactttgacttcgacaacttgccgccattgttaaatcaacaaaatgcagatatgattcacgccgcccaggaatatttacagacccattcggcaaccaaataacctaaccaaaaatcccactgagtttaaagcctcagcgggattttttatcgaattcaatctggcttgtatcacgaatacttataagtcgtaagcaaattaatttttgactgttcgttcaaaaatcgtcattccacccatgcaaaaatatgcgtaaccaatccggactttccgtctccggtgttgtctggggatgctccggatcggcaataatcgcgatacgagcaattgccgtcagcggcacctgttggatttcaaacgtttcgtaattgtaaagcgctaagcaacccactaattgcgcatcatcctcatccttagtcgtggtgctaaataattgaatcggataaataacctggtcgaccatccctacagtcggctggtagtagtgcatggtcgtcaactcatgatacgtgactgcatgaatcaacgcctgtaacaaggtctcgttgacaccttccgtactacccgcaactagctgaacatgacgctgataattcgccagcgcatgatacgtctgatcacctaacgtctgccgcaatttttctaccgttatcgctgtcacacttggttctaagcgttgaccaccctgataatttggtaatgcggagactaacaaggctgccaactcttgctgcgtaaacgtcgcgttggtgcgactaggtgttactggatggtaaagaactagcggttgtgaggagaagtgcaatgctaatttcagtgctggttgtacgcgcggatcaccaaacggcgcccagctgaccatgaagccggcctgcatatgtgcactaacctggccaactcggtaaataaccgcgggttgcgcaacatcatcgaccaagttatcattcagccccgtcttggtttgagcactgataccaaccacataaaagctactagcgttcgttaagaccgctgctgaaatgtgttcattttgccaccgctgaaccacgtcggccttcgccgtcacttgacaagtaatgaggctgtccggcggcacttgtgaccaatcaggcgttaatagataacgtttggtgacgtgtaattcatcagcgggcgtcaaccatggcgataacggaacctgctgatacttaatcgggtgaccattgcacatcatgacaattgttcctaacggtgtctgtaacgaatgcgttggcaccgcccctaaatttgtcctcggcttagccaatcgttggcggatttgcaacgcctcaatcggacttgggactgcagtagtccgccatagcatcaattcaagatgctgtttttgctgatccaataccgtcacgatgccatacaatcgttgcccctgatccatcagtgtcgcgtacggctggttctgataccgggcaatgtagcctaacttagcatgttgcaacgtccacactgagatggcattatcatcgtattgattgccactttctcgctggagcaacaccgccatacccactctgagcgtcgttaacgttgccacaatatcatcgacataccgttcgccaacgaccgtgactgtatccaatgcgacggctgcatcgtctgttgaattttgttcagttacttgaacaactgtagtcactggaattatttcaatgtcagctgtttctggctcgtgggcgcgaactaacagttcttgcccctgattaatcacagcgataacccgataggtctgcttcttcaacgtcattacgctcatgccagcttcaattcgttccatagcggtcacccccttaacaataactttattccattatacgaaagcgctgacagtattaacagctttacgaattgttttacacgtcagcttacaatatcttggattagttatctagttgccaacatcatttcaaatgtttcacgtgaaacattcattagttttgcggctgcacattaaaaacgtggttatcctacaattcagaataaccacgcctattttattaatttgctagtcaatgctatctacgccacacaagcccgcacaaacgccgcaaataaccgcgcctgcatggagtttacctgttgcatcatttccggatgccactggacacccaactgtagaccaccagctgtcgcctcaattgcttcaacaacctgatccgcactttgggccaccacctgaaagcccgttgccacctgtttcacggcctgatgatgaaatgaattgatcgcgattgcgtcactagtggtgcctaaatattcagctaaggtcgtaccaggtacgaccttcacgtgatgcatgccgtaagcggccaattgtccttgcatgtgctttaaggtaccctgaccagctggcagttcactcatatcctgataaagattgccaccataacacacgtttaagatttgtaagccccgacagataccgagcaccggtttaccaacggcgtgggtggcacgaatcagcgcaatttcatactgatcccgttccggatctaccccacccaatttaggctggggttcctccccatacgtcaatggggccacatctgcaccaccacaaagtagtagaccatcgatcattccaacgtaccgttcaatcgtcgttgcgtctgtcgttaccggtaataccaatggcacaccgccattatccgttactgatttcaaataatcacgattcacataatcacggacccgccccgggaacatctggctgttcactgtcacaacgcctggtgcgattccaattatcggtttaaccattctgtcgccctctctcaaaaaaatcccacggtaacatgcgcattaccaatgggattatcatttactttttacatctaattgtcaatgactaagctcgcgatatccgagtgcagttggtttgacgataattcccgtcaaccagacggcgatgctcagcccaaccaatactaatagcgtcgtgccaccaatgaaatcaatggcctgtaaccgataataggcgacaatccccacaacccaccagcaaaagttcaaccagtatggtaacgtagcgtgccgcacaaagtacgtgacgaagataatagcatatagcggtgtgaagaccgaaccaattaaatacaggaagttctgataatacgtcatggcaaccgtcagcgcaatcaatagcccaactaccgtcacaccaacggctaatcgattaacatggcggctaccggtcagattagccaaactcgtggcggccgaataagtatctaaaaatgtcgtcgtcaccgttgagaaaacgataatcagcaatgcaaccaatcctaaaccggaccgcgtcagcaatgccgtgatatcagtttgccctgtccgtaacacaactaatagccccgtcacaaacatcactaaactgcctaacatatagccacccgcgctgactagtgcgactggtaaaggacgatcaacacgctgggtataatcaccaattagtggcaaccatgagagtgccatcgtaacgttcaattccactgcttgcccaaacgtcatactagtcgttgataccgactgactagttgtcggtgccataaataccattacgagcattaacaccgtcccgagcaccaacaagcccacaacggcattgttgattttgaacagtaactgactacccatgagcaaccacgcaataatcaaaatcgccacgatggttgccattaatagcggacttcgaaagccaaatagctttccactaatactgttcatggctaactgagcattgacgatcatcaccgccgtccagccaacgagttgcaaggcgttgagtcctgacgctagtaacaccccgccgcgaccaaaagccagttgggctgacgctaacgcggactggtgtaatttagcccccaaatagccggctggaaccaagaacaggccacagccgatcaagtgccccaatacaatcgcagccaatccgcgtgtcagccccagtggtgccatcagcgtacctgttaagatttcggcaattgagatagccgcaccgagccacagtaaaaattggctccgaaaaatcccgtcatgtttcatcagtgaccctccgtagccgttagcatcgccttgaccgtggcagccatatcgggactacgcgttaacattgagatcaccgcagcgccagccgcaccagtagccgcaatagctggcaattgcgcgacagtaattccgccaatggcgacaacgggacaggttgcagtcacgactaattgtcgcaagcccgtcagaccgactactggatccgcatcggccttagatgtcgttggaaagatgggaccactaccaagataggcaatgccttccaattggttagcaatctgcacttcagctaaggttgaacaagacaaaccgacaaacatttgattagcgacccgttgaataacttgtgtcacccggtcgtccttttgaccaacgtgaatcccatctgcttgcagtgcgagtgccagctcgacatcatcatcgacgataaagggaacatgcgcttgcgcacagcgttcccgcagctgctgccccaatgcaaaacgctcagccgtagtcaactggctattgcctttatctcggtattgaaatgccgtgatgcctgcatccaaggccgtttggacgaccacattcagatcctgtcccggcacgtcttgtgtcccgcatacaaaataagcacgtaattgtgtgggttcaaatttaagcgtcatgaacgatcacctgctcacttggggttgcccaatgattcaacgggccatgaccatgcccgacctggataccatcctgaatcgtcccagcaacgtacgccttagccgttttaatggccgcagccattgaccgtccttttgctaattcggcggtaatacatgccgatagagtatctcccgtgccgtgggtccgcaccgtatcaatccgtggagccgaaagccaaaaggcggtcccgtcagccaacaatacgaagtcattagctaaatcgggattatcaccatgcccacctttaataatgacattgtcagcacctaacccctgtagcgaatgcccagctttaaccatcgcttgattgctagtgatagactgtccggtcaattgttccgcttccggtaaattcggtgtcacaacagtcgctaaagggagaagttcgtcgcgaaccgttttaatcgcatccgcggctaataacgccgccccgcctttcgcaatcatgactggatcaactgtcagcggcccaaaatcaaatcgtttcaagttctcaacgacggcatggacatgttcagcatccgcaagcatccccgttttacaagcgcgaatgtctaagtcagctgctaacgaagcaaattgttcgtcaatgagcttcgtcggcattgccataaaatcttggacccccaatgtattttgagctgtcacggcaacgactaccgcggtaccaaaaacgtgacgtgcctgcatcgtttttaaatcggccatgacaccggcaccgccaccactatccgtaccagcaatcgttgccacttgtggaaattcattcattaaatctcgcgacccttcattatatttaatcaactttagcaattatttgaatttctgacactgtcactaagctcagccggtcaatcaaatcaatggcaaatgtggcgggacgatcggccgtcaactgactggcgacaagttcccccgctcccgctaagactaagcaagccacttgcgccgcctggtaaatatcggttggactaacggctgtaaaagccgcgacgatactagaaagtaaatcgcccgagcccacgtgacgttggaaaagcggggtaccattagcgactttaacaacgcgccgaccatccgtaataacatcagtaggtcccgacaatatgacacagcattgaaattgctgtgcacaagcttgagcaatttcaaccaggtcgccctgaccgctccccgcatcaatgcccttcgcttgccaatccatgccagccaatgccgcaatttcaccagcattgccccgaataacatcgacttgaaaatcagatagtaatgctagcgcgacttcttttcgataagggaccgccccgacggccaccggatcaagaacgactggcttatgatactgattagcaagcttaccaaccacccgcatttgatcaatctgggtggtggtcaaggttcctaaattaatgcaaactgccccggcaatttggaccatcgtctccgcttcttggacttcagctgacataattggcgaggcccctaacgcgtttagcccattggcaacgtcttgaaccgtaacaaaattggcaatgttaaaaacaatcggattgtgatcccgtaaagtattcaataattgtaattccatagcaattctcctcctcattgaccatcacgccaattaaaaacggccaccaatcaacatgcattgatccagtggccgctaacattagctgtgacactttcctacgcaagtttgagcttacaggttcaaagggatcggtacttacagcaccatctcagcccatttttggacacccctagtgtttaaaaatattcaattactaaccttagtctaacgattgtaaccgctaacgtcaatctttccgttagccgaatcaccctcattgctacttaattaattaggcattaaagtttaaattcaccgccgcgaccggttataataaaaagcaaatatgcctttaagaaaagagtgattgaagatgcaagcacttgttgtgccagatccatccgctcaaactatggaacagcttcaatggcaagaacggcccatgcccaacctcgggccaactgaggtgttgatcaagacccaagcagtcgggctcaatccggtagattttaaattagttgcggcgggtaacgccgcctggcaatatccacacacactaggactagacacagctggaatcgtggaggcggttggcgctgaggtcactaattttcggcctggcgaacgagtttgtgggcacgctaatctcgccaataatgggacgtttgccgaatacgtgagtttaccagcagccgtgctagctaagattccaacgactgtgagctttgaagcagccgccgctagtctctgcgctggattgacggcttatcaggccctcctgcgcaaagccaatttaaatgccgcgcaaactgtgctgatccatgcaggtgcgggcggtgtaggcagtatggctattcaactcgctaaggctgctggcaagaccgtcttcacgaccgtttcacaggccaagcaagccttcgtggcaccgctgcatcccgatgcccaaatcgattaccatcatgaagatgtgaccacacgcattcaagacctaacgcagcagcacggtgttgatctgatcattaataccattggtcatgctgatgcggacttaccgcgcttagcttacaatggccagcttgtctgtgcattagcaactccggaccactttccaagtaatcaagttgtaactatcagtaaattggacctcggtggtgcccaccgtagcggtaacccagcgcaagttgccgatcttgggcaaatgaccgccgccttattagctttggtccaaactggcaaggtcgacccactaattactcaggtcttgcaccgtaaccaacttgtaactggtttacaacaactccaagctggtcaagtcgttggtaaactcgtcgtgacttttgacgcctgttgatctaaaaatgaagatacgaaaaacgcagctcaagggcggccttgaactgcgctttttggggtgtcaggcgataatcgcaacatgtgcgtatcggctggggttacgattatcatcgggtgggcgaatgaaccatgatcaccgccgttcagccgcccatctccgattaatcccgacaccactatcattaatttgattaggcctaggcgaaagtggccaattgtgccttggtcaacgtatcattcatccgaccactacggaagccacctaaatcaagggtaacgtagcggaatccaagtgattgtaattgacggttaacgcggtcgttaaagactaagaaatcaccaattcgtgcttctggtaattcgatccgcgcaatatcattgtggaaacgaacccggaccgttggaaaacctaaactacgcaaatatttttcggcggccattacttgagcaatattgtcatgtgtcaacgtcgtcccgtatgggaaccgtgaagatacagagcatgacgccactttattccagttcgtcaaaccgagttcttgtgccaaggcccgaacgtcagtcttgaagaaatcagcttcttgtaacaagctccgggcccccgcttcactacgggccttcaaaccaggacgataatcattttcatcattcttgatcataccgtctaagacagcggcactaccgttattagccgcaatgtcattcaaccggctgtagaacatcttcttcgcatagtaccagctatcaggcgtgttgttcttgatgtggtcatcgctcaagtagtctagcgtagttccttgaacgttagcacctagttcttcggctaaactcatcgctttatcgaattcttcatccgtaaataattcagagttcgcaaccacagcggtcacattgtcacggcctaaaacatcgagggccatcttcaaaactaaggtactgtcgatcccaccagaaaaggccacggtgacccgttgtaaatcctttaatgctgctactaacgttgctttttttgttgctaatgttgccataataaaacccttcttctatttaatttaattaattccaaaaaagccatgcataaaccaagcggcaattgctgccccgacaaagggcgcaattcctggcacaatgataccgtattgccaatcactatcggctttattggcaattggtaagatggcgtgggcaatccggggccccatatctcgagctaagttcattgcgaacccagttggaccaccaagtcccatcccaatggcccatacaagtaggccaacgccaattggcacgattcccggcgttttaatctcagaaatcgctaaaatacccgaaataaaaataaatgtatcaaataattccacaaagaaattccgcggtaagttacgaacggctggtgccgtacagaataagttccgaattgtaatgggtgaaatctcatctgttgaggctttaaaatgatcagcatacatgatccaaacgatcactgagcccacgaccccaccaagcacttccgcaacggaatacggaataaataaagaccatgcgatatttcctaatagacactgcgccaaaaccattgccgggttaatgcaaacattgccaaaaatgaataaggcaacgctaatcccaaaaccccaagttgtaatggcaaaaatatgaccggaaccccgatacttggttccctttaatacggaactacaatgaacacccaccccaaaaataatcattagggctgtgcccataaattcagcaatcaactgatgtaccaaaaaattacgcctcctcatctaattgatctaccgccactaaggctgcctggtagaccgttctaaacggaatatgaaattgctgcgccagctgggcacaatccgcatattccggcatcttcttctcaatatcttgatatgtcgccactttaacttgaacgtcaccgtacggcgttgcgaccgtcaggaagtgccgttgcataatagtacgttgccacgtctggtaacgtacaccaatcgtcgtcgtttcttgtaaaatcaacttagtcagtaagtccttatcgttaacgtttcccaaaaccgttaactttgtcgccggccgatctttcttcatctgaatgggcgtgaaaaacacatcgtatgcgcccgccgttaataactggttcatcacgtaccccagtccttcacccgtctgatcatccagattagcttcaatcattaagacagcatcagccgtccggttaacgatttgctgacttagtttttttttcgaataatacggctcgcagtgcattgaaaccacccgtgtcccgtttaccaaacccataaccaactctagttggcacggcattttccggtaacggtccgaattcacgtacgagcgtcttgaccaagcccatcccagtgggggtaatcaattcagtatgcacatccaaccgttgttgaatcggaatagcactaccaactcgcatctgcatcacggctggtacgggaactggcatctgaccatgggcaacgttaataaaaccactaccatcacttaacggtgaagccatgatggtatcaatctgcatcaattccaacccaatacagcagcccacaatatcaacaatcgaatccaacgcgcccacttcatggaaatgaacttcagctagtggcatgtgatgaaccgctgcttccgcttgcgcaatttccataaagatcgctttcgcgtggtgtttcacggtatctgataagtcactgccgtcaattaacgcctcaatatcagctaaatgacgcgcttcatgatcatgatgatgcccagcttcatgctgatgatggtgatgttccacaaaaccatggtccttaccacccgcaacctgaacatcaaagctcgtgccatagatgctactctgggcttcccgttgctgcgttaattcataaccgtgcacgtgtaacttagccaattcggtttttaattgctcaaaatcaagtcctaaatcgagtaacgcgcccagaaacatatcaccgctaatccccgaaaaagcgtctaaataaagtgtttgcatttatcttctccttgttcagttaactgaatcttacatttgattgatcatactagctgagtaggcggcaccaaagccgttatcaatgttgacaacggtaatccccgacgcacagctattgagcatggtcaatagcgcggtcataccttgaaaactagtaccataaccaacgctggtcggcactgcaatcacgggcttatcaactagtccaccaacgacactggtcagcgcaccttccatgcccgcaatcacaatgaccacccgggcaccacgaatcacatccaacttggcaaacagtcggtggattcccgcaacacccacgtcatagactcgttcaacacgattgccaaaagtttccgcggttactgctgcttcttcagcaaccggttgatcggaggtccccgccgtcaccacagcaatgtaccctggtgttttcggtgcgggttgttccccgaccgtcatacactgcgcagtggcatgatagacagccgttggtaacgctggttggagtgccgcgaatttttctgcggataaccgggtcgttaaaatcggcaacgtctgttgggacaaggcttgcacgatacccacaatttgggttgccgtcttaccagcaccgtagatgacctccggaaagccattgcggcgttgacgatctaaatcgacattggcaaaacctaatgccgctgttttgcccgcttctaactgttgggcagccgccgtcggacttaattgccctgccgccacttgttgtaatatttctgctgtggttgccatactacttcacaataacgcctaaaccatcaggaataaccgtcactttagcggcttgaccctcgcgtgcgtaggccttttccatggcttcatctaacgtcttggctagttccatatgcatattcgtaatcaaatcaggatcaacgaggtctgacacaaaaatcacgtgatgatgaactaagattcgagcaaagatttgggccgtccattgatcaggaatagttttaagccgtggcgtgttgattgcttggtccaggaattccttaggatcatcaacgtcagctaagttgtgataaaacccttcaccaccgtgaccatcacgagcaccggcaaccataataatcgtgccgccttctttgtttgttgcttcagcagcggtcattcctttaacggcctgataaatattttgatcaagcggataaccaccattcgtcgaaatcgcaatgtcacaatcaatggctggtacactagaaagttctttgacaaagtcacagcccactttatgggcggcttccatgtcaccggcaaatgacccaatgatttttttatcttcgtctaaaacaacattgataataaaggcaagtttagcggtccgagcagcgtacaccatatccttatgaatcggattatgcattaaattaccggtccgggccttcggtgagttaataaattcgccggaatggttcgccataatcgtcttgtatgaagcaatcccaggtaaaacggacttccgaccacctgaaaaaccagcaaagaaatgtgattcgataaagccttcggagattagcaaatctgcttcagcagcgaccttattaataatgcaatcgccgccagatggtaattggccaatcttgaccatactactgtcatcggttgagacatgcatcacgatttcttcgttattgacgatgtcttcaccatacttattcaccaattcttcgtgggttgatggccgatggaaaccagtagctacgaggatccgaatccgtgcatcgggcgccactgaccgtaaccgccgcaataggatcggggtgataatatgtgaaggaactgggcgcgtgtgatcagaactaataatcacaatattgtgcttcccacgagcaagttcctccagcttatcggagccgattggattatccagcgacttctcgaccgtttcctgttctgataatttgttatgatatgttgcagcttgcgacactaacttaccggcgtaattttcatcatcaatctgagccgtaattgtgcgcttgtcatatggtaaatcaattgcaaccatgacttttagccatcctctttctctaaaaactaatttttacatgcacgttttgttatactagaagacggataacttgtccgttacattttaagttttcaaaaatagttaacaaatgtatactttaaatgcgattgtcacaatcatgaaaaccgctatgcttaagtagcgttatcgtcgtgattactgttgagaatcgctatttttactgacctcaaccttaaaaattattcacgaaagaactgaaaaactaagatggtattaactgatattgaatatttactaagttatttggaagcccatcacgtgccgacaatcaaaaaaaagcggcatacttacctgacctatcatggtttagccgaacactatacgtacgtcttaaaggacggcatcatcaaaaacagcattattttacaagacggtcgcgaatataatttatcttatattgccaagcccgacgtgatctccctgctgcgtgatgaagtttctcgttctacggatcaaccgtttaacgtccgtattgagtccgaatatgccactttttaccaggtcaaccgggtcgctttttggaagtacgtcaacagcacgcctgaactgcaaaactacgttaaaaattattaccgtaaaaagttgtccgaaaacattcttcgactgcaacggatggtcatgaacggtaaaaaaggagccatttgtgcctttatctatagtcttgttgatttgttcggacgaaaagttaacgaagggattctgattgactttgtggtcaccaatgacgacattgccggtttctgtggtattagctcccggagcagtgtcaaccggatgctcaaggaattacgaacagacggcgtcattacggtcaaaaatcacaaatttattattcaagatgttagttacctcttagatcaaattgcaaattagtgaggtgctcatccgtgcatattccggataattatttaagtcccgcaacttgcggaacgttggtcaccgcgatggctcccgtctggaccgtcgccgttttaaaagttaaagttcaaatcaaaaaacatcatgaaaccctgccaatgctcggcatcgccgcttcattggcttttttaattatgatgttcaacttgccgattccaggtgggaccacggctcacgctgtcgggggaaccctgttagctgtcttgattggcccatgggcggcgtgtcttgcgctgaccgtgacgttactactacaagccttattattcggtgatggcggtatcctagcctttggcgctaacgcgttgaatatggcggtcattatgccgtttgtcggctacgcctgctatcgcctaggtcaaaaatggcaccatgaaaagttggggctcgcaattggtgcttacttaggcattaatatggcggcgctagttgctggtatcgagctcgggttacaacccatactggctcatacggcaagtggtgcgccgctctactgcccatacggcctcaacattacgatacccgcaatgttgacggctcacttattagtcgccggctgggtcgaagtcgtcttcacactgcttgtctttcaatttgtaaaacgagtcgcaccgactaacctctatcagacacccactcggcgcaatcagcggccgtggatcgcactgctactcggattagcggtgttatcaccattaggcttgttggctagcaatacggcttggggcgaatggagcccccaagaattacagcaacggctagcgcaacaacatatcagtactcacgcgcctcaaggaatggtccacgggttccattttcaggccctgttcagtgattacgccatcgcgggcttaccggtcagtgtgggttatattttatcggccattaccgctgttttgattttcttacttttgattcgaggtcttcaacatgaaaccgacacgtcccaacactgatattccagcttggctgcaaactacgaccaccacgccaacacctgctattaaagcgaaattttggcaacgtaatcagcgtcacctacgccaattactcagtcgactagcacagccagcgccagtcacggcaacgtctcattggcgcgttgcaccgcaattcaaattaattcagctcctgttgctcgtcattttaattgctttaagtaataatctcattctgttatggggcctagcactattagttgggtgccaattattatggttacctccacgccaactgcgccgttttatgggaagctggctaatcagtgttgggatggccatgctgttcgtattaccgagctactggttagccggtcccaccacgctattattctttggccttaaaaccagtctaatgctggcaaacgctcaatattaccgtctaaccacgccgtttcaagatttattggctggcttgaaggcactccattgccctgatctattaattatgactttggccattgccatcacgtacttacgaatgctcggccaacatctattgctgacgatggaagcactagaattgcggacggtcgccccaacggctcatccataccgtttaatcggcgcattatttggtaatttatatcttaaaagttacacttatgcgctagaactatacgctgccatggaagcacgcgggttcaatggtcattacgcgcgctcaaccgggcgtcgtacccattggcgcgattatcttgccctgagcccagcgattattgtctggatattatttattttttggaggcattaacgtggtattgattaaattggtgaatatttgctatgattatcctgatacgtgtggcttgaaggacctcagcttaacggtcaactcaggcgactttgtctgtctaatggggcccaatggatctggtaaatcgacccttttacgactattgagtggattagctagtccaactagtggcacttatcagtttcacgatcagccgattacgaccacttatctcgctgatgcccaaaatcgacaacaacttcatcagcggatcggcatggtctttcaaaatactgatgttcaactattcaacacgtcggtcactgaggaagtcgctttcggtccccgacaactcggtttatcagcagccatggttgcgcaacgcgtcgccgactgcttacaattaacggactgtgctaacttagcagaccgggtcccttaccaactttcaggtggtgaaaagaagcgcgtggcactagccagcgttctcgccttgaaccctgaaattttattgttagatgaaccgctgaacggcttaacaattgccgctcagcagcaaatgctaaccctactgcaacggctacaagctgccggcaaaactatcatcatggcaagccataactaccagcaagtccaagccgttggtgaacgtttcattatttttaacagtacccaccaagtcgacgctgacctaacgcgcgctgatcttgatcagcaacccgcttggcaagcgcaattgatgactttataattaagaggagttgagaagagatgcttaatccaaatactgagatccatcgtggttggaaccggcgcgttgtgaccggtaagactttagctgaatgtgatgaacgtttagtgaagtatttaaacgaccaagattatggttctggtgaattcgttgttttacacgaaaatgacggtagcaacgaaaacactggctatgatttacctgatggcgataactgctacattagtttcttgatttataacagccgactttaagttggtggtgacaaaaatgcttactggtggatgatcgccagtaagcattttttgttaaactcacaaactattctgattttaagcccaactcggctaacatgattcgtgcaaacgccactaagtttggacgtgaccatcgtataacctgttcgtcctgttgaccagcataggctgctaacgcctgcctgatcaacggatgccactgtgttggcagctgttgtaacccccattcacccccggcctgcttagaaataattaactgatcttgctggtaagcgcgaactcgacaaaggtttaataccgtatacattggtaactgaacgatcgccgtttcagcattcgcgatatcagacttgatactgtcccagtaggccaccgcaggaatggggccaaagaccgttgtaatggctggtccaagcaagacttgtcccgctgcttggagaattgttaagtgggcagcaagatcaggatcagtaccgtgcatcgtctttaggtaggccagcggtgcctgttgataatgctcataatggtattttgaaaaatgaaaatcgaatgggcaaggatgcgcaaaatgctgagttgcactaagtaacagcacgtgaaactccaatcccttgtgtggcgctaatggccacaattgcgttatggtagctgtcattaactgccgtttttcagctaatgttaacgaacgccgaacaacgatcagatagtctaaatcgctcacctgttcgttatatgagcctaaaacataggatccatgcaggtaaataccaacaaggtttgtttttaaaattgcggtggtcgtttgttgaatggcttgtaataaccgtggtgtcgatgtcatcatcaaaccactcccctctaagtcttgagcttagcgatagcacgaagatgcttaatcaaccacgcttcatcgaaaagcttttcccaatcacgttcgatagaaatattgccagtttgtttgataaatgagcgatgctgataagtttctaataacatattttctcccgtgaagatgtgttacggttcgtgcgtatcatatcatacaacgcactaaagaaaataacggactgccaagtgccagttgtttcacgtgaaacatcctacttcaaataaacacgagtcagcgcttcgcacaatttttcattacactcttgagcgttatgaatggtctgcaaaacttgctgctcgtcaccttgtggttgtgttaataccacccacacgtcaacgttcgcttgatgaacatcatcactcaaatgtgtcggcaaagccgttgaactttgcggtgtgggtagattaatttgttgtaacgttaaaccaagttgatcaattgccttaattagcgccgccactggtgcttgcattggttctgccaacgtctcacttaactgtcgaaagccaccgctatctcctagtgcccagttgccactaaagccaaccgcgtcaatagggtcatccgtccgacgataagtcacatatcgaactggcatcggtccctgagccaagagtccgggcatcgtttccaagttcgcattgatctcagctaaaggtaattctcggaaatcatggccgactagttcgtaacgaccaccaaccaattgataatcaactagtcccatcgccttaatcaggccagcttgcacttttaaaccatcgtaaccaacttttaacgcatcgaacacatcaatcgcttgcgcgtcggttcgaaaaccaaagtttggccccgccccttctggataaacgagattacattgatactgaaacgacatgccgattacacctaagtcttgattggcccgcttcgcttcatcactaaattcaccgaaataaccggctacaactctaaagctcatgtttagccctccttaatcttgtcaccgcaatattgaatccgttcacattattgatgtcattataatttttattcgcgcataatgaaagtaattaatgcttgcagccgttattaaaagccacgcaacactatattaatcctcggtttatttacgaacatcgttttctgtttgactaaatttatagttgaacaatatttttccagctcttgacaactgattttcaaaagcggtatactcacttcaacaaaatatcgtccttataaaccaatgaggtggagatcaagattatcgtgcccgcacagagagtcatcgttgctgagagtatggccgaacgcaggtaattaaatggaccaccgagggctttgccgaaattaacgtcagttgagagtacggaaagacgtgcgacatacgtcagttgtcagggaaatgttagtttcctatggagtaggagtgtacgcgtgatttaatcactaaattggcgaacactcaattaaggtggcaccgcggttatcaaaccgtccttaacacagcattggctggataaggacggtttttttgacgataaaaacggggtgaaataaatggtcacgaaacgatggcaaaactcatggatcaaactaaccaaatacaattatatttttggaggatttaattatgagtttatccggaacacacaaattaattttaacaatcggcagcgtggctattattggcggcatcgggtttaccgtcaacgcccactcgcacccagctacgactaaacaatcacaagttatcaatctatcagctggctcagaaattatgagcttagatcccgctaaaatgacggacagcgtttctaatagccaagtcacccaagttgacgaggggctctatcggctgaacagtcagagccaacccgtcaacgctttggctactaagacaactgttaccaatggtggtcatacctatatcattcaattacgccacgatgcgcgctggagtaacggtaacagggtgaccgctcacgattttgtctattcatggagacgaactcttgatccaaaaaataaatctgaattcacctatgtcttcacaaacattaaaaatgccgacgccattgcagccggcaagaaaaagccatcaacccttggtgtcaaagctaatggtgactatcaattaacaatcgcgttaagcaaacccgtcgcctactttaaaaagattttagctgtttcgaccttttatccggtcaatcaaaatgctgttaacaaatacgggaagaagtacgggacttcagccgcgacgaccgtctacaacgggccatttacgcttactggctggaccgggactaataatacgtggaccttaaagaaaaatccagcttattacgatcacaaactggtgaaactgcaccaaatcaattatcaggttattaagtccaatacgactgcctataatttatatcaatctaataagttagatagtgtgacacttaatggcgagcagagtgtccagaataaaaataatcaagaactcaaaacacttgcgggtggtcaaatcagctttattcaatacaatcaccatgaccatgtagcagccaaccgtgaactccgcaccgctttatccttagcaatcaaccggtcgcaactgaccaacaaagttctagaaaatggttcgcttccagccaaaagctttggtgtgcgcaatatggctaagaatcctaaaactggtaccgattttgtcaatgatgcgaccgttgatggtactgttaattataatctcaaccaggctcgagccgcctatcataaagcacaacgacaattgggcaaaaaatcgctaacgttaacgattacttgtggtgatgatgacaactcacatcaggtcgctgaattcatccagggacaattaaccagtcacctccccggactaaaggtaacaatcaaggcaatgccatttaccgcaatgctaggtaaagtttccaagggagccttccagcttaatttaactagctggagtatggattttgccgacccttcacaatcattaacaattttgactggcgacagcaactccaacatgggccactatcaaagcaaggcttacgaccaggcaatgcaagccgctgatggtccagatgctttgaacgcgaccaagcgctatcaagacttagttcaagccgctaaaacggcgctaactgagcaggccgtgaccccactctacgaaggccgttcccatctgctcgttaagtcgcacttaaagggcgtcatctataataatttcagcggtgccgccaattatcggaccgcatatgtgaaataacgcctcatatgttgctcctaaaattacccgaccaaaaagcgtttcaagaccgtagcttaacctaagccggccttgaaacgcttttagtataggaatccagtgttaattaaaagtcagtgtttgcttctcgccaccaacacccgcgtcaacaaaaagatcagttagttttaattcaaaaacaacgagtgtcgatccaatagcatcccagacttgttgataattcggaactgtttctaaatattggggtagcaagtcggtcatcgtcttagttgaccgttgtaacttaacgtgttgggctcgtagatatggattgcccgctgttccatcattaggaatcgtaatgaatgcaatatccggattctggtcataaaccttcaaagcgggacttgtcttaactgatgagaagtatagcgtatctggttgtgcttcgtaccagacaaagttaacaattttaacatctgcttcattattgacggccgtgctgagggcaatcttattagttgattgaaccacttgttttaatagtgaaatatccataccgacaaactccttttactcaattagtatcataatttcattataccgcaattgatagttttaggaacgtacgtttgtctaatgtgctatcatatttctatagcttagtttttgctttaaatgctatcaacattatttataaactgaacgcttcgaaagtagtgaccttatgaaaatcatcattgcacctgcgaaaaaaatgattatcgaccaagatgcctttccagccctaactgaaccaatctatcttgatcagacgcaacaattactggctcaactgcaacacctcacctatcctgaggccaagaccttatggcattgcagtgacaaactagcccaacctaattatgattggcttcaaaaaattgacctgacccgcaatctgactcccgctattctcagttacagcggtattcagtaccgttacatggccccggacgtctttacccaaccagcccttgactatattcaggcaaacttacgaatcttgtcaggtttttatggcattctccgaccgtttgatggtatcgttccttatcggttagaaatgcaagcacggttggctgttggtcaagccaagaacctctatgcgttttggggcgaccgcctctatcaggcactgactccgcggccagaaccaattatcaatcttgcttctcaagaatatgctaagaccattgcaccttatctggctccgcatcaatcaatgattgatattgtctttgcaagccttatcgacggcaaactcaagactaaagccacattagctaagatggcacgtggggccatggtccgttttttggctgaacatcaaatcgatgatgtgacggccattcgcacatttgaccatcccgattatcaatttgacgagaagcgctcgacggccaatcgattcgtctttatctatcaacattaaacatcatcacagcaatcaccaaagcgcccgcagaaggctaacttccacaggcgctttggtctactttaaaccttttaataatcattatagtgacagccaaacaaaatcagatcacgccgataaacttctcaatctagctattcagcaaattatttcccgggaaatgattacgctcatttctctaatcatgggctgctagccagtgacgcaatcgcgtcatataggtcgtgttttcatcgataaacgccatgtgacggctacggggaaataacgtccaagtcgcatgaggtaactggtcgaccatggtcttagcgactaatggcgtacacaaatcatccgttccactggtgactaaagttggcatctgcaaatactgtaatcggtcggtatactcataatccgccaacgtaccagtcggattatattcattgggaccccacgctacattataagccgtggtccccacccgttttgatcgccgtaggaattcaggatcatcagcagtaatcgggcccgacgcatgttgcgtcataaaatgttgattagcagtcaggtaggcagcacctgtgaaatcctgtaaccgttctgctgtcgcaatagccgactgatccgctggggacattaaccgaatcatccgatgctgttcctgagcccacagtcgggctgaagacaaggtactggctaaaatcaaacttttaatcccctgtggtcgatagtcacaaccataaataatagctagcataccaccccaggactgccctagtaagtgaatctcgggtaagtctaaatacgtacgtaacgcctgtaactctgccacccacgttgcggcttgccataattgatcgtcatcaggtatcgatgaacgcccacagcctaattgatcatacatgacgattggtcgtcccgtttgaacggccaggtcatcaaatccttcaaagtaattatgcgttgatcctggaccaccatgtagcaaaactaacggtgtcttatttgattgccgatcccctaagattcgataatacgtctgataaccattaaatggcatgtatccttcttgcacgtccaaaatatcactcactttcgttactaattttttacttgttacgcgttatgcgttatgcgttatgctagccgctatttagcattagccttgattaaaacgtgccaaacagatggattcctgttcgtcagcaatgcgcgtccgattccgacctccggggctgggtgacaattgctggaacgtaagccgacgtcgattagagcccgtgcacaacccgcccagtctcaaatacgagtcttattctaagccggaagcaacccacttccgactaagaataatttggctactgagcattgtcacccagctcctccagtcggtaagccgctcgaatggctgatgaacagccacttaacttggtacaattggtcgctgactattttgatgatggaaccttaaaagaaacgttagggttacattaaccactttgttgagacgttcgattattactatggcgattccgaaatagtgagctatcacaatgtcattttctacctgacagctgctcgacaaaattgctgtttatgaagaacaatgatgagtccaacaaaagttaggtcccttactgtctgccattcgaatactgtcccgactggaaggcgtttctgacaatgcccagtggtgaaatttcacttagcaagcgtcctgtgcttggttagtgaaaggccagtatttgagacgtgggttttcggctcaaatctgtgcccaccacgttccggcaattggcagaaatgcctggaggtcggtgtaggacgcgcactctaagcaagtttacgctaactcgaactgttcccagcgaacctaagctggctgcttttgaatttaaaaaatggcacgttttaatcataatcgatgacaaattaactcgcacaatgcgtacttattccattccaatactaatgtccacctgaaaaagtgaaaaacttaattccattctaatacaactcaaatgacaatggtgatgtaagcgctacaatagaagtgcagaaataatcagaaacgggtgaataatgatggtattaagtattattacagtattaggaatgggattaattgcagccactggtgtgcactttatcaatggcgcacaagcgatgcacgcaggaacggtcggccatcatgttggtcagatgccggctaaccttcaccaaatcgacttacgttaatctcttaaaaattcacgttaatttttagcattgccgctgaaacactgggcaatgctttttttgtcgttcctttagctgaccgtccttatcagtttggtgcattgagcagcttgacagtcaagcgtatcattaacttatattatctttctgttcgtctagtcacgcttcgaccgaccgttcagagaaggagtgacttatttttatgaatgatttatttgagaaggccccgattcccaaagcgtatttccatttagcctttcctgtggttcttggcatggttgccagcatgatttataacttagcagatacattttttgttgctcaaactggtaatgctgatttagttgctggtattgccctcggcagtccgctattttcgtttatgttagcagttggtgatatttttggcctcggtgggagtgccgttatttcaagagtccttggccgtcatgattatcaccaaagtgcacgtatcagtagcttttgtttttacattgcgatcgcgcttagcttagtactgacagccttattattactattcgaacaaccaattttaggcttgctaggtgctactgcagctacccgtccctacattgcggacttctatcgtatattggtattaggatcaacctttatcatcgtttcactggttcccggtaacattatccgaacggagggcctggcacaactttccatgattgcgaccatcagtgggacggttctgaccattattctcgatcccttattcttatttggctttcactggggtgcttcgggcgttgcttttgccaacgttttggggtacgcggtcaacaccagtctgttagtcttttttatgcgccgagccaaaacgctctccttagcaccaaagttagcccatatctcgcgaccaacccttaaagccgtcgtcgcggttgggattccagcctcactgactaacctaacccagagttttggcatgatgatcttaaacagctacttagccgcatacggcgcccaagccgtggcggccatgggaattgttcaaaaagtttacatggtcgttatgatggtcatggtcggctttgcttttggggcccagcctttagttggttacacgtacggtgctaaaaattggcaaagactacgggcaacgttgcgcttcgatttaaaagtcgaaggtggctacgcaaccatttgtgcgattattctaatgatttttgcgcctcaacttattaaactatttatgaatcaaccagtcattgtcactatgggtacacaaatgttgcgagcaatgttgattacgacaccattagtgggcttcatcctcgtgttcacgaccgtctttcaatcagtcggtgcgggtttgagtgccctagccatggcgctttcgcggcaagcaatcttactaggtatcgccatcgttattctggcacagttctttggactaactggtattatttgggctcaagcggtcgctgatgtcttaacgtgcttacttggctggttactttatcggcacaccttcaaagatattcaagtaccatcctcaaattaataataacgatatcatgtcgttagctcactgataatcattaaatggcgccatccatttcaggtactggtgattcagtgcgctgaactgcataagtgaactaaaagctggtacttttggaatgagaggcgtcattccaaaagtaccagcttttttcactctgattcatttttttattcgtctacagactgagtatgggctaaatcggcttctaatgacgcagtgagtgccttcaataattttagagtcgccgtcatgttagcgcggtaataacgttcagtacctgttttgctaaccgctaaaatgccggcatccagcatcaacttcaaatggtgcgatacggccggtcgtgataaggcgatttgcgctgtaatttggttaaccgtcatctgatcagtccggcacagcatcaccaaaatccgttgccgattttcgtcttgaagaattgtaaaaatcggaacacccttcttaaatattgccatcgttcgttctgccaaaaaatcacacctttccaattacggttcgtattcttaaaccatttaacgcttgctaaaattgaaagtcaagaattaatcgttgactttttgtaagtaagcgactagaatcaacagcatgatttgttcaagatgttaaacatttaaaccaatatgttaggagtccactatgaaagctgccattattactaaatacaagcaaataacccccatggtgacagaagtccctgttccgacaatagctcccaccgatgttctcgtcaaaatcgttgccgccagtgtcaacccaatcgatttgaaaaccaaagatggcgatctaagattgttactacaatacaccatgccactaattatgggcagtgactttgccggtgtaattactgccgttggcgaccaagtaccggactttaaagttggtgatgctgtttacggtcgcgcaccaaaagatcgaattggaacctttgctgaatttatcgccattgatcatcaagccatcgcactgaaaccagccaatctcaattttgaagaagccgctgcaattccattagtaggtttaaccagttaccaagcgctacacgatataatgaacatccagccgggacaaaaggttttcattcccggcggttcaggtggcattgggattattgccattcaactggctaaatatttcggcgcttacgtcgcaaccactaccagtgcgaaacattttgacctcgttcaatcactaggtgctgataaaatcattgactatcatcagcaagactttactgatgtattatcccattacgatgccgtattagatactcgtggcgggcaatccctcgaggccgcttttcagattatcaaaccaggcggtcagattgtcagcattgccggactgccaaacgcgcgttttggtaaggattacggactgccaatatggaaacaatggttattgggtctagcaacgcggaaactgagtcgactggaacaacaagcccaggctacctattcgtttctgttcatgcaacctagtggccagcaacttgtgcgcctgcgacaactaattgaacagggcgttattaaaccggttgttgatcggattattcccctcaccgacatcaacgccgcgttagaatattcgcattccggtcacactaccggtaaaatcattatcagtattcaacctaattagctaactaatatacttcaaatcagtctttttaaggagtcatgatcaatgaaaaaagttttaattgtcgaaaccaatatcactcgttaccaaggaactaatgagccgactggtctttggttaggtgaagccgctgagttcgtcgatgaaatgcagcaagcccaaattgccgttgactatgttagtcctaatggtggcttcgtgccccttgacccgcgtagtatgaaatataccgatgccgccacaatggccgtgtatgaagattctgacttcattaatcgggcccttaagaacacgctcaagcctagtcaggtcgatcccgatgattacactgctatttactataccgggggccacggtgtgatgtgggactttccggacaaccctgagttacaagccatcgcactggccatttatcaacatggtggatatgtgacctccgtttgtcacggaattgctggcctcctaaacatcaaagaccaaacgggccaatacttgattactggcaaaaccattacgggctttaccgcaactgaagagctgattgccggcaaaaaacggatcgtcccgttccttaaccgtgaacgagctactgctcacggtgctatctttagtcagcatcgattttatcgcgaatatgcaattactgacggccaattgatcactggtcaaaatccgttctcagcacgcgcggtcgcacgccaattgattgctaaactataaaaaaacgagcacaaggctcgtttttttgcgttaatcttcaaaaatccgctcatgcaaaacaccaaacggcgcatgatcgacataaatctgaccagtgtcgtgaaatccattacgttgataaaaacgctgggccacagcattatttgccagaacaagtagataattctgtggatagaccgcctttaagcgacggtgggcctggattattaattgctgaccaatgccatgatgatgatagttcgggtgaacatatagcgaatacagttcgccccacccctcatagttcgcatgtctggccggaccaaatgtgcaaacacccacaacttcaccatcagccgtcattgccagcaacatattttgccaccgccgttccggccgccaagttgctggcgtcaattgctgtaaataacttgcaggcatcaaatcacgatatgctgattgccaggtctcataatataactgtcgaatttttccaaaatcactgtctgcttcagcgcggacgatccgataggttagtgccatcagcctgaccacctttcaattcaagttgtccctaagtgaggcacattttatcatttatataaataaggtacccaccaactattcataaagagcatcaattagatgaatgtttcacgtgaaacaaaaaacacagtacaaaaatgaatccagtacaacatgttcattttgagtttggtattgacctgaactatggccgaactcgtcgcatatttaacacgtttggcagaattacggccgtaataataatggccacgccaaccatttgcacccaatcaatagtttcatcaagcagtacaaatgcaacaacaatcgaggctggtaattctaaagaagaaaggattgggccaatgccaagctctaagtacggcataaacaatgaatacataaccagtgggaaaaccattgagaatagtgcaatcagtactccccagccgactgttgctggcgtggtgggtgccgtaactaattgcggtgaccacacgatagcaatgagtatgaaagcgcccaaacacagtaaccatgttttcgataacgggtctaagttattgcctaagctagccgtaaactgcatcgtgcaagcatacgagcatgccgctaaaaaacttaacatcaagccccacggcgagagcgcctgcgtaattggaaacagaccagcagctaaaatcgtgcctatcaataccaaaacaatgctaaccacttgcagtcgggagggacgccgatgatgaatcactgctcctagtaatgttgatatccagaccgcctgcatcaacattaccgcggccacagcaactgggataagctttaacgcctgtatgtaaaaggtgttagtaaatcccgaagccgttccagccgcaattaccagtccgatttgcttccaattcgtttgctgattacgcaaacgtgcacggcgtaaaatttgaatcacacctaaaatcacaaccgcactcagaaaggaccagaatagcaatgggccattgacaaccccctgccgacgcgcaattttaaatagtgacgccggaattccaaaactaatggcccctaagccaacgaacaggggcgcaattttcttcacattaatcatcctctcgttgacaagatatgttggagccgggcacgataccaccagtctggcaagcccagtgagtagcgtatcagcatctcaccaataatttgcacaattgggcgtcccggttgtatttggcgttctaacaagctgtcataaaagtcagctgggacactgactaagtgcccgttaagattgacccgtaacggcgcattttctaccacgagcgcttgccattcataactatgagcacgttgttcgtccttagaaacgtcttgtgccaactgtaagtaatgcgcaatatccgctggcaatacttccgataaatccgacaaagtctgtaaagctagacctggtcgagttatcacttgacttagcggtaccatcacttgtctcaattgcgcgtctgtgtctgctaactgctgacacagccagtcgtatcctaaccaatcatcgggcatggtagaccaccatactcgtagcacgccccctgctcaacttgagactttaatgttaccaacgcttgcttgacaaccgtggcatcggtactgtgtgacatgatagcaagctgtgctggatcatcagttgtcaatcgagttaaatcaccgatttgtagcgacaatggcaaactcaatactggctggtgcaactcatgttgcaaggttaccgcaaacatcgaattaaacgtcacatccatcatctgaatttcctcaatttctattttgatggcgccttaaaatgtgccaattccgtattcgaataaacgtacgggacgtgcgccatctctggcacttgattccaagccaccggataacccgcaccatgtgcgcaaaagaccgagtccggtgtattttctaaatctgctgtggggacatatttggccttatcgacaacagccatctcgttatgacacggccgatagccatccacgatacattccaattgcccctgcccatgcgtgtaagctcgaaccgtctgtgaatagtcctgcatcgctgctactggcgccgttcccgtaattgtcgtcaggtcagtcccgtccgtggctacgcttgtattagcgactggtgcgtcaaactgaccattcatccgctgaatatcagtcatcgcccggccaacttgttcctgaccaacttctagacggaaccgataccacggttccaacaactgacaatcaccacgttgttttaacatcatcaagccttgacgcaacgcgcgccacgtcgcttcacgaaagtcaccaccaaccgaatgaacattgctagcccgaccactaaccagtgttaccttaacatccgttagtggtgcgccaatcaggacacccacttgtgttttggcttgtaggtttgacacgacttggtgttgccaatttcggccaagcacttccaatgaacaatcggtcgtaaattgaagcccacttccccgcggtgcgggcgtcagcaacaaatgtacttccgcatagtgtcgtaacggttcaaaatgcccaacgccttcaacagcttgggtaatcgtctcttgatacaagatactccccgttccaaactttacagtcagttgaaaacgatcctgcaagatttgttgcaaaacttccagttgaatcgttcccatgacctgtactcgcaattcctgaagtggttctgaccaagtcacgtgtaattgtggatcctcatcttcaagttgacgcaaggctgctaagcaggtgtgtaactcctcacgctgaggatcaagtgcgtaagtcagtacgggctgcatgacgggttgtagactagttgctgcctgtcccaatccttgccccggccgcgttcccgttagaccggtaatggcaccaacggatcctgccgtcagcgcggacgtggtcgcatacttagtcccgttgtaaacccgtaactgattgactttttggtcatcatacacgatatctttaggtcgtaaggtgccaccggtcatccgaatccaagtaagccgttcaccttgatcatcgtgcgtaatcttgaacacccgcgcgccaaattcaggacgcgttaattgtggcgtcgtccaataatcaagaccagccattagcgcatcaaccccgtccagcttaagtgccgcgccaaaataacacggaaaaacttcccgccgttgaatcatctgccgaatcgtggcatcgcttaacgtccctgtttctaagtaatccgttaacacttcgtcattttgcatcgcaatatcttcaactgccgcagtcggtatgactggccgatcttccaacgtgtccccggctcccggcgtgttaaacgccacacaaccaggcgataatgtctgttgaatttgttgtatcaattggtcgctatccgtccccggcgcatccatcttatttacaaacagaatggtaggaacgtcataacgggctaataatcgccataacgtccgcgtgtacccctgcacaccatcagtcgctgaaacgactaaaattgcgacgtccaaaactgacagtacttgttcagtctgggtcgcaaaatcgacgtggcccggggtatccaagagtgttaaattaatgtctttatattgtaaattagcttggtgtgaaaaaatcgtaataccacgctgtttttcaagcacatccgtatctaaaaaagcatcgccattatcgacgcgccctaattgccgtagcgcgccagaccggtatagtaatgcttctgacagcgtcgttttaccggcatcgacgtgggcaataattcccgctacaatccgtttcatattgggctcccttcacgattagtgaatcactgcttccagtataccggttctcagcactgaacggctagtaaaggtctgccactaacgttaaatatgcatgaattttggcgtgttttagtccaatgttaatcaccaaaatcaggctagttactttccatagttgcgatcactttaaagtagtggtgacccatttcccgtgcagtatcgcaaaaaaggtatccgtagcctacaactaccgataccttaaaatcattttcagacttaatcataaaaacgctcaaaagctgccttcaggtccattttggcttgctttaatgcctgtgataccgccaccccgttcgtttgcagtccttgtgcacggacgatctcaaaccggtcaaaccccataatttcagtaaacatcttgtcaagatacagccgagaaaattccatgggtgtataacggtcattacgagtatagattgacccactggcctgcagtaacatgacacgataattatcggtcatcaaacccactgatccattttcggtataacgaaaagtctccctggcaactaagatattatcgatatagtcctttaaccgtgccggcacgttgaaattatgcaacggcatcgcaatcacaatccgatgatgagctttaaactgttgtaggagttgctgattgattgcaaacaggcgttgttcctcaatcgataaatttacatgttgcgcttgcttttcccagattcccagcaattcaggtaccgttgcttggggaatcaccgtatcatacaaattgagcacatccacagtatcattaggaaagcgggtctgaaaaagttgcaaaaaggtttgttctagttgaactgagtagtgcgccgcattacgaaaatcgggatgtgcattaataatcaaagtcttagtcatttaaatatctccttaattaataaatatatttattggttgtttttgacaacagttatatactacagtcgaaaggtgccaatctatgtcaccattaaaatcatttttaggagttatttatatgaaccgctctgaacgtcttaatcaagaattgatctttctcagttaccgacaagaattccacatcaaagaactcatgcaagaattcaatatctccaaacggaccgccttgcgcgacgttaactcgttagaacaacttggtttgtccttttacgttgaaccgggacgttacggtggctaccaactcatgcaacaacaactatgggtacccatcttattaaacagccaggaaattaatgcgctcttttttgcgctcaaagcactcagtttattgtcggcgaccccctttgaaaagtcctaccatacaatttacaaaaaactcatggcaacactatctttaagcaaccagcgccaggtcgccaaattgcaacgtgtggttaactactactcaattcctaacttggatgccccaacccatttaagtgatttattaacggctatccttgatgaaaatgttgtccagttaacgatgactactgtgacagctaggtttcagatttttgatttattatatcggcatggcatttggtttttcagtggcgtcaatctcgataacaatgcttggggcatctatcgctgtgacacgatcaaagcatttcaaaccagtgagcaaccagcacggtatacttggaaacagctcgcgcaacggcaacggtcctacgatcaccatcatcacaatatacgttataaatgtgcactaacacctctaggccgtgaacatgtacaaaagaataattatcctaatatgcacttaacacatcagaacgaccaagattatctcattggtggttataatcaagatgaattagcctatatggtcgactatttactgggacttggccgtaacgttagaattatttatccggaagcgttaaaaactgcctatctgcaagaactgcagcaaattcaaggcttctatcaacgtttggttttctgaacaaaaatgtcggtagccccgtcaaggactaccgacatttttactaacctgcttattctcttcttaactgctttattcagccgtaatataattcaaaattgcattcagaacttgttgattctctcgtggtaccggcgtttgtaaaatttctgctgctgttcggtttaggaccgaccccgcaatataccgataatcattgacgaccatctcacgaacattgtccgcagccggctcaaagtgaaattgtaaccccactacccgatgcttccatacgaagccttgattggtcacacgatcactagagaacaacagcgttgcttcggctggaacggtgaacatctcctcgtgccaatgcaagaccgacagttttgctggaatccccggaatcacgggactctgtcggtaaatcggtgcccaacctacttccttagctggcgccttagtgactgggtatcctaaggtcttcgcaatttgttgcgcgccgtaacacgcaccaaacattgggatatcgcggtccaataattgttgaatcaagtctcgttcctgcttgatccatggcagcgtatcgttgggactcatcggtccgccgaggataacaagcatctccgtctcatccgccgttgggagaacaccgaattgatacgggtgatagacatacatggtatgaccatgggcatgcgcccaatcagcaatcattccagggccctcattgggggtatgttgcaacacattaattcgcataattagtcctttccacaacggcaatgtttggtctgggtatcgcctgcaattacccaagatagagtcattataccacgctaattacttgagccatgggcgcttatgttaaacttaaaaccgatcataatttagaggtgataataatggacgtccaatcttttttcgaacaagctaaaacgacgctcaaattgacacaaagtaccccattacaaagtgcttatcagtttggcagcgatcctgataaacttgcacagctcgtactaactggcacaaaaacggctaccaccagcgcttatgacctatacgaaactgatgaaccactgccaaaagtgggcgcttatgacgtcatcttagatgctcataatcagcctgtctgtgtgacccggaccgatcaagtcatgattacgccttacttggacatcgatgcaacccacgcttacttagaaggtgaaggcgatcgtacttatgcctattggcgccgtgttcatgatgccttcttcaagcaggagtaccaaagcgagcatcagcgctttgatccccatactgcacaaatggttctggaacgcttccacgtcgtttatcccgttcactaaaaatagcgttccaatcggcactggtgaattcgcttccattagtggtatattggaatagaactttcattagggggaacgacacatgcatactatcgaacaactcaatgacgggcgcgcggtctatctaaatggtcaccgcgtcaatgtcgccgatgtgcccatttttcgtaaaactttagcactcaataatcagtactatgacctgcaacacaaccatcccgaagtacatacttatcaggaaaatggtcaccgctacgatattgctttcaaagtgccacgcaccgtcgctgatttacaacaaaagcaccgtgcttatcaagaaattgcgcaaagtaacagcggcatgttaggccgcacaccggattttcttaatactgggatggccgtcttagcagaacgcgctgccttcctcgggcaaaatcaatatactgattttgcagctaatgcccgcaattacgctaaggaggtcaaagctaacgatatcttcattagccatgcgcttcaaaacccacaactcaaccgtcaaaaagccatcaatgccattccgtctggatacgcgggtgttcataccattgaacgtaatcaagatggaatcttcgtttctggtgccaaaatggtcaatacgatggccccaattgctgatgacctcctgatttttaatccgccggaactgttgttagaaaacggcgatagtagttatgctgtcgcctttgctacgccactcaataatccgggcgtcaagatcatttgtcgcaaattattagatcatcccaccgcttccattacggattacccactcagcaacgcccttgatgagattgacgcctacattgtctttgatcacgcctttattccgtggtcaaaagtatttgttgaaaataatgttgaaatgagtaatcgtttcttcatcgattcaggcatgtttagccacacttcccatcaagatgaggttcgaggtattactaagcttgagttagcaaccagtttagcgcttcggattgctcatatcttaggattagatggtttcttaggtgtccaagaaaaactcggtcggttaaccgctaatctggaactcatcaagggtaccatcacccgttcagaagacaacggtcatctggacgaattcggtatctatacgcccagtctccaagctttgcaagcggttcgctcgacccttcccgagtactatgacgaggccttgcgcgtgactcaacacttagcggccggttccatggttggcgtgccaagttttgcggaatttgacggcgataatgcgacaatcctcaaccaggcactcacgacggaccgagccaccgctaaaacccgcacgcgcttgttgaacttagccttcgatttaacaagttctggctttggtcagcgccaattgatgtacgaatactatcatggtggtgatccaatgcgtattcgtgcccaacattatcaacgcgccgatttacaggctggcaatcagatgattgaccgactattgtcagcggacaacgcaaacacccatgaataagtaatcacaccaatacccaggttagtccttaagtgagtattggtgtgattttttgtgtctttagattattgactatttagtcaaatataattcgcgtaactgttgacattccgctgaggtcagccctagccccgtctgcaagtaatttgaaaatgtgtcgtaccgggctttgatgacttcaaagtaatggctcaggtaatcagcatctactaataatgcctggttcacggcccgttgttgctcatcagataattgcgacgccatcgtcgccaagatttgttgattagcagctgcacgtgcttgatttgtgagcagatagtcagccatgatttgctcgtcactaatacccaaaatttttagaaataaggcggccccgacgccggtgcgatccttaccggcaaaacaatggaacagtagtggctgatctggaaccagtagtagctgtataaattgacaataactttgacgggcagtaggatctaacgctagctgttcatataactgaaccatgcggtcatggaccgcccccgtactactaatcatcgattgtaaacttgcgtcgttcgtcatgacttgtgctagcacatccagcacgtgatactggacgtgtggccatgtcgcatctggaaattgatgacgctcatcagcactacgcatgtccacgattcgcgtaatgccaagcgtggttgctagatactgcgtctgtgccggtgttaattgatccaattgtcctgaccggtaaattaaaccatctttgattacttgctgatttttattgcgataaccacctagcgaccgtaaattagtaatcccttccatgaccaagccccctgctagattgataacttaattgtaaactgtcaccgttaaattttcagtcaaaggccatttaaaaagtcatttagtcaccagacctaactgatctggtgactaaatgactttttaaccgctaacttgatagactcaattaatcaaagtgtcgccattcgtgatccaacaacgcacgcgctacaaatagcccgagcggtaaaaacatgatgattaacacggccttcgtcagccatagtgaaccgacaccaatttgattattgccaatactataaattgcacgataaatatataatcccggaaccataattacgattgaaggtaccgtcaatgaaatccggggatagccgttataacgattaaccaccgatgcgatcaagccggcaacgagcgccccacaaaaggcggccgcggccggtggcattgctgtcaagtcaactagttcaaggcgcaatgtattcgcaatggccccaataaatcccgcggtaatggccattttttgcgagctattaaacattattgagaacccgtaaacaccgcaaaaactagctggtaatcgtaataaaagtaccgctaacggtgaaagtcctagcggtaagaaatcagctggcttgaagctcaccagtgtcgcgactagccagccgacgagagttgcaatcagggtaaccataatcgcgtaagctaagcgctccagtcctgagcgcatatccaacttagagatatccaacatactcgtaatgaacggaaaacccggaatcacgaataacatggcaccaatataccccgcctcatgctgggcaagaatttggaaattatattcaaaaatcttaaaactaaccatataagccaaacacgctaccgcaacgctgaccgcaatcccggcaaccgtcgtcatcgaccgtttacccatcagcgcccgaacatagttaccaaggcccgcgcccaaaaaggaacaaatcatctcgggaatacctccaccaagtaagaagataaatccactacaggctaagccagctgccaacccaagaaccagtggcgaatactgtttaggacgcgtctgaacttcatcaattgctgcatgcacttgtgccaccgttaaccgtgcatatttcgcatcaaagtctttgacaaactgttcaagaatatttagtttatccgtatttacaccagtatttggtatcgataatacttgcgtataactacgttcatgatgaaaacacgtgtactgaatcgaaatcaacccgatatctgccgagcacgttaaattcaggctgcgagcaatcttattcatcgcatcacgaacccgccacgctcccgtcccacacgacaacattaaaataccaactcgaccaacaattgatgttcgctcttgtaagctagcatgcttagcgggaacatcttcattacggataaagtccttccatggaattgtcatatgatgtcgttgtgatagcggcatcaccgacttacgctctttattcatttcttcctccatcttagatcgtccattatgttagtagctttcccccttattttaggctactaacatcatttatgatagcgattttgtcattttaaaagcataatgtttcacgtgaaacattagcctcatgatgagtttccccagcttgttaattgaactaccccctcaaaagtaaacttgattaccattcgttaatttaaacgtcacaattttcgccgctatccgcaatcatatgataagttaccggtatcatctaataaaggagcgatttgtatgtgcactagtctaacttatacaaatagtcatggaggccacttcttagctcgtacaatggattttaacgttgactttgagacccgtattatgttcatgcctcgacattaccgcgtgacgggtgaccttggtgatttcaccacgacttatggctttattggcgcgggtcgccaactgaaccatgaaattttcacggacggcgttaacgaatgtggtgtcagcatcgcagcactctactttccgaatcatgcaatttaccagcctcacagtaaccaagacaaaatcgatctcgcaccccacgatttcgtcgcctgggtactcggaaaaatcaccagtgttgctgacctacgtgagcgcgtcaaagacgttcaattaattagtagcacggcagaattaattaacgaaattccaccacttcactttatcatcagtgaccaaaccggtgaaaccgccgtcttggaaccaactagcggcgagcttcgcctgcttaataacccagtcggcgtcctgaccaattcaccaaacctcaaatggcagctacaaaacttaagtaagtatggcaccctgactaacaccgagcgaccactaaataaattcattaactaccaacctggttcacagggacctggtacgggcgcattaggtctacccggtgactatacttcgatgtctcgctttgcacggaccgtcttcttgaaacactatgcgcaagtgccagcgacaacaacagatacagtcaacttacttcaacacatcttgaatgctgtgactattcccaagggcgccaaagtagccgccaacggccaagcaacctatactgagtaccgtagctacatggatttgaatcatcaaacgtacgcactagaactgtacgaaaatccgggagtgattcagcaagttaacttaacggatcatttattagaaaaacagaccgttccgttagaatacgtccttagtcgcaccccacacgtccagttactaactcccgatgttgccaccttgccagcggcccattaagactttcagaaaagcagtaactcaaaaaagcttgcatcacaaatctagttgactttgtgaagtaagcttttcgtattatttaaacttaggctaacgcggcttttagattagctaaggttaattcgctcgttgaagtgaagttaacatccgcacccgtcaaaatggcaggatcaccaatcccaatcgacgtttcaccagcaccattaattgactgaataccgaccttagcatcttcaacgcccgcacattcttcaggcttcaagccaagcacttccgcgccacgtgcgaagatctctggatctggcttaccgtgtttcaaggttgcgggatccacccgggcttcaaagtaatgcgccaagcctaactgttccagaaccaatggtgaattcttagaagctgaggccaaggataaacgatacccatgcttggcgagatcggctaagaagtcttcgataccaggtaaaattgcagttttatccattcccttcaacaggttcagataattagtatttttcttggctgcgtaagccactttttcagcttccgtatagtcgttttccttaccacccgtttttaagattaagttcaacgagtccattcgactaacaccctttaaattatcggcaagttcttcactccaggcaacgcccaactcgtcagctaattgatgccaagcttgtgagtgataaacggacgtatccgcaatcacgccatctaaatcaaatacaaaccctttaatatctgcaaatttactcattaatggttcctcctcgttaattaccagcacaattgattgctgggtaccggacaactgcgcaatcatcaatagatgcgccaagagtgacggctacccgtcttgttttgaagcacaccgttaatgttcacttaacattataaaacgctttcagtttcaatgcaaccggttgcatagcaattttaatgacgattgttgccaatcacacgcctgcccgccgatcaaatcgcaatggcggccccattactgccgtccatcctgaatttacggatttactaataatgactgatccagccatttttccacaaacggttgcacgcttttatgccccgcttaatcttgggtcggaattggaatatccggtcgatactggtactgatgctgggttaaaaattgccgtaatttaaaactagcagccaatttaaagcacgtttccgcatcccgtaaatcgcatccggtcagtgttgtgatatggtgcagtcgattacgcagtgtatttggatgaacgtataattgcttagccgtgcgggtcaaattacaagtcgcccgtaagtagacatctaatgttggtaccagttctgtatggttttgctgatcataggccaacaacaaacgtaaggctggattaataaagaacggtaagatctcaaggtgattaactcgtgccaacgcaaggttatagaattggtcttcacaaaaaatcacccgaccacggccagtcttcagttgcgccgttcgttcacaaactgtatacgcggcaaaggtatcttccggattaacgtagtgctgagacacgatcaagcggcaatccgcttgcttcgtaatttgctgcaacgttagtttaaattgattctgattatatgcgaccagactaattgggatcagtgccacacattgttgctgataagtcgaaaccaacacttgtttgaatcgtggcatcatcaagtactgtagtcgctgctgtaaaatcatcggtgcttgatcagctagtggttcgcagcggattaacaccatggctgtcggtaattgcacgtgttgttcagcaaactgatcagcaaacgttcccccttgatgttccgtcaataataagtttaataaccggtcccgttgcgattcggctgttggcataatctgatttttaactaacgagccagcgataacctgaccaatcgaattgatcagtagtgcttgtcgatcattcagtggtttattgagtgctggcatcaccaaataaccgagcggctcggtgccatttgctaacggcgtaattagcatgggccccgccgacaactgatcttccgccacatagacttgcgttaaaaaatccggcgtatccggtgcaaatccgtggtctaacagccagcgtccgactcgattcgtctcaactgcggcgtgaatactagtcccattgagttgcgtcgtatgcgaccgtgtcagaatttccccgttcagatcaataatcgccagcggattctctaataagcgtactgcttgggccagtgtggtatcaaaatccgccgtgattgcttggatagcgagctgattgatggctgcttgaatttgaacatcgtggtgtaaacactgaccaagcgtcattaataatttcaataactgattttgcgccgcaatgattgtagtcagaccggttcccagatttactagtccgaccgactgacgatggccgtgccaactataagtaagttgaactagctgactcgagtcgggggacaaatataaccggtggcttgctaacgcttccgtcggatcaacaaattggacgtgagtaacttcgggattatgtgtaaatgttggatcgacagtcacctcaaacgttgtggctaactgccgcaataacggctttaattgcatactcaagtaacctccttattcacgcttgtcgccttcatcataaataatgtaagcgcttttgtaaagaggcctactgataaccccccccaccaccctcgaaaggtcctcagctttcttaggcccgtattcggacaaaaaagagcgggaatcccgctcttttcataaacctattaggctaagaaatcagtctgtgttttggcatcgtaccgagtcgtatgaagcggttcttgcgctgctttcccgattgcgattcccattactggcacgtatcgtttaggatcaagacccagcgtcggaatcatcttttcaaagtcaattccggagaacgcattggcatcatacccatgagcccgtgccactagcagcaactgcatcccgacaacggaacaatcaatcgtcgcatcgaatttcaagaaatctggtgtggcattttcatataatggtaagaaggttcccagaatctgatccaagcgttccttcgtaatattcccatcctcataaactttgttccagacatcgcgataaacataatgcgactgggtatcaccggcaataaagacgatggccgatgcactgtcgacctgtgggtagttgaatttcatcacggcttgtttgaacttagcctttgcctcgggggtatccacgacgacaaagtgccatgactgtaaattacatgccgatggcgcggtggctgcttccgcaatcatcttttgtaactcatcacgtccaattttaacgttcgggtcaaactgccgaactgaatggcggttaaacattacgtctgctaaatcattgttcaccaaattttttactgcttctgacatcagctattcctcgctttcgtaatccgcctaaataatgtaagtcgctgccttgggattgaagaaactccggtcataccgacccgttaagagctttggcattgttgtcgcagcatcaacttcgtccaacttcagtgtgttgaacataactgacgtgtcgaagtggaaccaagcggcaccgagtggcttcaagaccttcaattcgccaaatggatcatcatcggttgactccaactgaatacttaggttcccaggttcaacttgatcagctaaggaccgtaactgagtcgcaactaattggacgttactgaaatggttcgtcccatcttcatgttgatcaatgtcatatttatagaagaaactattcatttcggcttccttacctaacgcgagctgccccgcaaattgtttcataattgacggatcattcagttcaccggccgtccacgaaacgttcagtaatgtcttgccatggcgttcgaccgtggctgtcgcactgttgtcattccggcgcaattcgatgtcatccgctaatttcttaggaatcccagcaccttcccgacctgcaatcacaccactctccgccccgggaccgtggagtaagaggttaatcgggtaagcgcccatcattttatccttgtagctaactaacgcaaataggctttcttcaaggtatggggcactaaaagtcggttttcccatatgaacgacataaccgcaaaccaccggtgccattaattttaatggtgctggaattaaagccttaagcaccgcttcgtcagtggcataagcaaacccaataccttcctggtcattcatgcttggtgctgtcaaaaagttcttaacatcctgatcacttgcaataaaacttgccatggtaaaacactcctttgtttgcgtgattagcttacatgataccgtccatgatgtgcacgtctggtgcgccatccgtcacgatccgtttaactcggtcttcaatcagtggattatattctggatgggtcaaaatgtagaaacggttatcctctaaggctttaaagacggtatcggcaatcgtatcaattggtttcccgttggtaatgacatacttcgcaaattgttgtccctttaagtacgcttcactttgataatacgggtccgttgggtcgctgtattgcgctggccggtgattttcagtgtgatagagatccgtctgaacaaagccagggcacatcacgtgcatgtcgatatcaatattagcccgttgtaagtcataggcggtcgcttcagtcatcccaacagaagcgaacttgctagcatgataagaaggcattccgggcgtatcaactaagccggcaatcgaagccacgttaagaatatccgcatgggtcttctgttgaatcataattgggataacgcgcttcatcgcataaacttgactcattaagttgatatgcatgatccattcccaatcacgagtcggcaattcccaaattcggccaggtagcgcgatcccggcattattaatcagtaggtcgatccgcccaaacttttccatggcctgctcaaccgcatcgtcgacactagcttcctttgtaacgtcagcggtaaccatcaacacctcggcacccttgtcgagaatatgttggtacgttttcttcaaagctggttcgtcgatatcaacaatcgtgagcttcataccccgatccgcggcgccttcagcaataacttgaccaaatccgtgggccgcacccgtgataaacataactttatctttaaaatctttcatgatgttttgcgtcctcctcgatgaaattgtgattttattaacttatcagtaaacattaacctgatgaccggtcatttatcttgactacgctttcatattaacccactaaatttgtttgagtaatggataaaagtactagtcttacgacgattaaactgtagcttttatacatgtgtgttggttcacaattataactaactaaagtgtggttccaactttaattagctaataaaaacgcatgccagcccttcttagcttacatgcgcatcattataattggatttattttcttaatactgcaaccgttcattgtgcacggctacgttgccgaaacattcaaggtccgtgccagatcaatcactcgtgctttgatctgatctcggacctgtcgaaatactagcaattggtcactaacactgccagtcgtgcgagccggatcaggcaatggccagtgtagcctggtcaccgttgccggagtgacggggcagcgatcccgtgcatcaccacacaacgtcaccacgactgcacactgattaagataggtcaggtcgattaatttagaaacctggtcactgatatcaatacccacctcgctcattacttgaacagctagtgggttcaggccatgtgtctccaccccagcactagcaacttgccagtttggtcccaataattgctgtgcaaagccttctgccatctgactgcgacaggcattgcccgtacataaaaaatatatttttggcatttcgccgtcctcctaaattactgacgataacgacactaatcgcgtatcatcaccaatattatgcccgcaagaatcccgcttgctccgctaataaccattaagatacaacatcgtcatgcgcgtaaccgcgatagattgctgtgactattccagcaatcgaataaactagccttaaccctcaagaatgcgctcactatatttttgtaatcgatttcaaaacgatttatactagaattgatattacaatattattctaaacttataaccagtccccctgagcagttactcatcgcgagaacggtcttatttcaactaatttatcggaggtcttttccatgacagtagcaattcgttatcaaactcgcaatggcaatacacaagcatttgccgaacaaatcgctagcgtggcaggtgttccagcacaatccatcgatacacctgtcgaacaagctgacacactcttttttggcggcggtacttattttatgaaacccgacaaaaccgcatctacttttatgaagaaccttgatccgactaagatcaaacaaatcgccctattcacaacttctggcggaccagaaatggtttcagacaaagccctgacaaagattgccaccgaaaagggcattcccgtcatcggccacttccaccaagtcatgggtggcaaaggaatgaaaatcatcggcagtactggcggcaagctcaaagatgagcagattgaactcgttaaggaattcgctcaaaaaatgttagctcaataatgatttgacggcgctcgcgttgactgaaaaagtcaatgcgagcgctatttttggattagtgctgaagacctaattagcccgtctaatttgacgtaggacgtcaatgcaccgctgctgattagcgttaggcaaaaaggacttccgcaccgccagttgcatgtaacagtgtaattgctcttgggcagctagtggaatccctacaacctgatcacttagcactacggaatccgcaatgaccaccccaacaccaacgttttgagcaactagaccttcgactaacgcgttggtagctgcctcgtagacgattttaggctgtatgtggccgcgctgacaatattgttctaatgctaaccgtggtaatgcgtgtttaggacgagcgatgataggcactccttgtaagtcagttgctcgaatcgtttttaagtgacttaatggactattgacattggccaagacctgcatctgatgttcctctaagatgctcacccgtaaatccgtggcacgttctgggaccaaagttgaaaaaaccgctgcgtctaacttgccttgccgcaagtcaactaacaattgttctgaatcagcaacggtcgttgtgacctggtctaataaatcaactgagataaatttttttatcacccggggaagccaaataccacccgcaacattggaaaatccgagccgaacttgctgctcattagcgtgatgaacttccagtgccatctgcgcaacgtcttttaagagttgcttagacttaatatacaaggtccgccccgctgccgtcgttactagttgggcccgatggttggcctgcgttagtaatactgcttggtattcttcttccaatcgtcgtaaagctgcagaaatagccggttgtgtgacgtgaaacttggtcgccgtggccgtgtaatttcccgtctcaactaatgaacagaagtactttaaatcgcgttcattcacgtcaacgcccccattcaatctatttaatacctaattttaacacgaaagatgcggcaaatcgtggtcaggatcaatcacgacttaccgcatctatattgctcagttagtcttaccaaaagcctaataacttggtccacagcaagcccccacctaaccagatgacgttaaaaataaccccaataattgcactcaatcgccaccactccgcactagtcacatagcctgtacttgacaataatgccgcgggcccggccgagtacggcgtcgttgacaagttgattgaaccagcaaatgccaatagtaacgccgctaaaacatggggaacaccggcaccaatggcgatggataaaaagccagcatataacgccgaaatctgtgttgaaacactcggaaacatgtaatgtaagtaaaaataagctaaaaacaggataatgagcacgctaatccagttcataccattcagtaaatgacctaacgttttggaaaaccatgggaaaaagcctagtgtcattagcttcttagacatcatcatgatgatcgataaccagactaaaatattccaagcaaaatgttcattgagcaaatcgttagtcgttaacacgcccgtaatcagcaaaataacaactgcaataaaacttacttcggtcgcatcgatgccaattttagtcccgatcaaccataaaacaatcgctaaaataaaggtaattgacataattttttcactagctgtcattttcccaagtgcggccaaacgcgtcgttgcccagcggtgcgcgtctggcgtttgtttcacctcagggggatagactttatatagtacccatggaataattagtagcgataaaatacctgggacacaagcagccataaaccattgcatccaagttaccgtgattccctgcatcttagctaaaccaatagccaccatgttgccagctaaaccggtcaaaaacaagcctgatgtaatattattaacttcatattcattaaaaactagaaatgagcctaattttcgctgtgtgccctgtttcggatcagatcccatttcacgagaaagattatcaataatgggatacataatcccgttgacccgcgcattattgctaggaataccaatcgccaatacggcatcaacaaaggataaggcgtatgctaagctcagcgtgcgcttgccaaataaactgacaaacagataggcgatccgcttgccaagtcctgatttaataaaaacagcagccatgaacatgcacatggcaaccatccacgccgtcgaattaccaaaaccagtagcgacttcgtccatcgtaaaaacacccgttaacgtcgcgacaacaatcccaatcagcgtgacggccatcatcggtaatggcttggtaatacaagcaataatcgttgccacaaaaattgcaaataagtgccacgccataatactaattgctactggtcgtagtggcgtaactagccataacccaattccaaaaattagcggtaacagaaagcccttccattttatttcactcaacatctgcacttcctcctaatcttcatataattgttaagattttcacatatcttgccattaacggttgtttgccgtttttcaatatcaccataacttaatttataagtctgtcaatttaaatttagttgtagttgcttgaggtgtcgcaataaaacccgttatatacagcctacagggacctgtttgcgattaaaaatacctgaaattatcatagcgactagtgccttttatcggacacttttataaatagaatttataaaaagctaaaataaagtttgccacttgcttaattctcactaaagtttcgacaacccgtcaaattaatcacagcttgttatccttgtcacaatagcattctgttggcttcgttaaaattaacggttgttttttctaggtaactatttatattgaaagcgtaaacaattcgtatacttatccaactaaaaactaataaaggaatgttaattatgaaatatattgccttgattggtacggcggcacaacagtcttacaaccgtgaattattacaatttatgaagcatcattttagtcaacgggctaccattgacgttaatgaaattacagggattcccctttttaatgaaccaactcaaaatcatatcccggcgaccgttcaagccttaaatgataaaattagccaggccgatggggtgatcatcggggtacccgaatacgatcatgccattccggccgcactcaagaacgttattgaatggctttcttaccagctccacccctttgctaataaaccggtcatgttagttggtacttcccttggcgtacaggggacgtgccgtgctcaaggtgacttacgcaatattctcaatgcgcccggagttgatgctcaggtactccctggcaatgaatacatgttaagctacgctgctaaagcctttgatcagaatggtcaaatgaccgatgccccttctatcaagttcttggaacggtgcttcgataactttgaaaaatacgttaaggcactcaacggcacgcccgcgctcaatgtgaactggcacggtaactacgacgtcatcgttttaggctttggtggtgccggtgcttcagcggctcgttttgctgctgataatggtgcccacgtactagtagttgatgcggcaccatttggccgtgaaggtggcaacacccgctactccgcccaacacgtcgttacgggtgaaagcttagataaactaaccgcttattatcaagcactgggcgcgccattcagtacccctactaagacactcaacgcctatttaagcggtatgagtaaaattccagcatattttgaaaaatatctggggattaaagccgttagttggaaacatgatattaaacccggtgatgccgttgccatcaagaaaaccatggcggaatacccagaactagccggaagtgatacgattgactttgccctcgttcacaaacgtgataaagacgctgcattatggaaactactccggcaaaaagtccttgaacgagctgacaatattgacgtttggttggactcacgggcacaacatttgatccaagatcctaatactaaagtgatccaaggggtccaaatcaaacggggcgaacgactgcttaatatccatgccaataatggcgtcgttttagctatgggtggttttgaaaacaatcctgagttaaagcaaacctacttgcacagtgatcatctgacaccacttgggacgctctataaccgcggtgatggtatcaaaatggctcaagaagttgatgccaaaatgtggcacatgaccaattatgaatctcacggtatcttacctggaatcaccttcaaagaagacgccaatgaacggggccgtcaaattgaacactggcctttattaaagaacggtagtattttcgttatcgctgatgatgggacacgctacttccaagaagacgctaagcaccgtcacggacacgtttacacacatggctcttggctaatcccaatgaataatcagcacccctacttaatttttgatcaaacccagtacgatgccttcaaacaagaagaaagtcaggctggtcagttaccgtatccgaaattcatgaccaaactcgtttccgcgccaacgattgcacaattggccgccaaattgggagttcctgctaataatctacaacagacggtaactgactttaatcactacacagaagtgggacgtgattttgaatttggtcgtgatccgcaaacgatgcgtcaactggacgatggcccttactatgccattgctgcggccaatgacgtcctcaacacgcaaggggggccacaacgcaatgaaaatgcccaaattctcaacgtcaatgacgaacctattccacacttgttcggcgctggtgaattaggcggtatcgttgcaaactgctatcaaggtggtggtaatttagccgaatgtttgatctttggtaagttagccggtgaaaacgctgctcgtccaaaggtagatagtgaatctgtcaccgccaacgaagccaacggaattaatgaccttgttgatggcgaaacagcatctaatgttaaactggccgctgatcaatatctcggcagttccaatgccgggctaggtggcaaagttattgtgcgtgtgacttacaacgaccataaaattcaagcagtcgatgttattcaacaccatgaaagtgaagatgttggtttaaccgctatcgatcaaattccacaagaaattgtggcagccaactccactagcgttgacgccgtttcaggtgcctctgcatctagccgagctattaaagaagcggtccaaaatgcgctgaaacaagtcaaagattcagtcacgaattaagcacaattcaaagcgaatatgtatttgagaacatcacgtaactcacgagttgcgtgatgttttagtgtcccgtggcgaaagtttcacgtgaaacattttaggacttacggtatttgatttccaaatataagttatgcaaggtgcctatcaaaacagacaccatctattgccaaaatcagcagtatccgttatactgtttatcgctgtggctataatcggccacaataaggagatgattaatgatgatggcatcattatctgtacgcaaaagtgctgctcgttagcgacacttttcgacagaacctttcagagaagtgtctggtttgaatctgaaaggaattatattatgcaaccgacaattaccacctatcaatacagttatattactcagcaagtcaatcagttaattagcgccgagctcgccgtaaacgatcttcaaattagagccgtcgtacgggcacaagctatcgagcggattacgccactgcttcctagtgacaatccaatcaccgctaatttcttgtcccatttgcaaacggaccggctaacccgtgccaaggcccctcaactacttgaaacgctaattccgctaattattccgtttccatccttgacgacaaagcaactaagcaagttgtttcgcaaggtcaaaaagttgaagcagcctgtatggtcacaattagcattacacgaattgacttacctaggttggaatgatggtggtaaccagaaaaagtatttagtaatcccggatcatgatcgtctcattggtatccagggagatttagcaccacaaacagtcaagggcgtctgtgccatttgccaaacaattggcaacgtcgcactctttatgtcgacaaccaagtcatctggtctcggaccttacacgcgtaacggcaattacatttgtcgtgacagcaatcagtgtaatcgtcaattgaccaacccgcaggctttagctgactttttagcagttgtccgtccaaaacgataattaaataaaaatcagggccaccaagaacagctgcaactgccgttcttggtggcccctttcattaatcttattcggtgacactaatacaataagcgcgtgttggcgaatcactaacttcaattcgcagcagttgcgccccgttgtctcgcaatgtcttatcaatcttggtaaataaatactccgtgacattttcaacagttggattaacagttttaaattcaggtaagtcgttcaaaaatttacctgacaattcatccaacgcttgatgcaagtttttttcaatatcgtaaaaagcgaccatcgcatcaaccgtgtgcaattcacaaacaatttcccacgtgtgcgtgtgcttttttccggagccagttgcccaccgcaccgcatggctagcgttgacataggacttaattttgtacgttcgttgtttagtcggcattgcccagcctcccctatcaggttcaagttaccctccatcttagatgaaacggtgtcggttggcaatagtgtctgctggtaaacagctggttttctgctgcaaaagtgagtctaaattagttgataatatgcaaaacttgcggcgtagcaactcggtcagttcgaaattgatttaacggtttttcaggcttctcatagcctaaagcaatccccatcgccactactttattcgcaggcatcccgagtgcatttcgtacaatggccggttatttaaccaattcataagatggtactgactgtactccgcgagcagttgcggccaacattaacgtctgcgaaaaagcgcctaaatcatagattgaccaactattagggttagcgtcgagtacgagataggcaatcgccggtgcgcgataaagattagcacgactatcccaataagtggtcgggtctgagtcaatcacgggccgaaaagttccgacccagtgccccatattttggctagcaaacgccgaaaaatcaccccggtgtactttggcgagatcagcgtcttccgcaatcccttgctcagcggcagtagcatagtgttgtttaatattagttagtgcgtgccccgttgcaatatagacttgccatggttgtgaattgccccacgagggggtttgctgagcatccgtaacaatcattgttaataactgtggctcaatagggtcgtctttaaaagcccggactgaatgccgggtgtgaatcgctttaattgtttccatgaatttttagctcctatattttaaatagtgatgaacaaagagaataaatatcattataaaagatagtactatctttttcaagtgagaaagcttggctagctaagcgcatcgtcataaaccagtaaactaaaaacgtggtaataccgagccattcatgctcagtattaccacgtttttaaccaaatcaggcccttgaagttacagtcaacaagctatgaacactggccttaacaaggctgtcgtagaccttattttaatgcaatctgtacccgtcgttgaagatctggcaccacggtcgcttggaaccatggattcttcttttgccagccataatttaggggcgatggatgcactaatgggaaataatcaggcaagtaatcctgataattttgaaccgttgcagtcaatgttttttgccgtgaacgtcctaaataagccttaattgcatattggcccacaagtaacgtcagttgaacgttaggcatcattgctaacagcggttcatgccatttatccatgaagcccttgcgcggtggcaagtcaccgcttttgcctttaccaggatagtagaaatctagtggcataactgcaatgcggtcactttgatagaattgctcccgcgtcacgcccatccaatcccgaagtcggtccccgctcgcatcattgaaatacgtcttggtattttgggcaatacgtcccggtgcctgactaatcactaaaatagtggctgtcggtaacacatgaaataatgggtcccaccccttcgccgtatattcagcgttatcgggatcagccttgatagcttcagtaatttctttgattgttgtgatatagatgcacctgcgattcgtttttagttttagtgacgatacttttcccatgcctgtttgattaagctcagaatatattcaatctgagtatcatcttttataattacttcatcatctccaatgaccagtgctactttgtcttattcaatttataaaaatccatattaatgttcatacttatactagtattttacatcaattagtcatagacacgaagaaaagtcctaaccatgttattgccctagattaaacacgacttcatagtcccaacattcgcttcagcagcttttcattacgtttattatggatcggtaccattaagcgcgtggtatattttgccaaaacaccttgcttatacacagatttttgattactaaacgtctcaaagcctgtcttaccgcctttatagcgtcccattccagaataacccacaccaccgaaacccattgaatgcgaacccgcatgcaaggataactcattaatatctactccgccagatgatgtctgcgaaataatttgattcaaatgccttgaactcctaccaaataagtacatggctaatggcttttcatgagagttaataaaagcgatggcttcatcaagtgaatcatacgtaaagatcgataaaataggtccaaaaatttcatttctggcaatctgtaaatctcgatcaggattaatcgccaacgttaatggaattagccgtcttttcacgtccggaaccaattcattatttggattaatcgttatcagcctagttccccgttgccgagcttcagtaagcattcccaaaatccgatcgtaagaacgatcgttgataatggcagaatattcagaattattaatgtaagttggaaatgcttgcgcaagttgtgcagtgattaagcgcacgtattcatccaactggtcagtgggaagtaacacataatcggtgtccaaacaaatctgaccactattaccagaacgactacgcgcaatcttggcagctgtcatttgcttgttagcatctggtaaaacaacggctggatttttaccacccagttctaaaacaaccggtgttaaattaggagccgccgccgataataccttcttaccagtttcagagccacctgtaaaaactagtttgtcccaatccagtgctgaaaactgagccgcaatatcagcttctcctgtcactactgcaaagttcttttcatttaaatactgttgtgacaatttctggaccagtgccgctgtcttaggggtatactcagagatctttaccatcactcgattccccgctgcaatcgcttctaccgctggatctagcgcaagatcgattggtgcattaaacggcgacatgataccaactacacctaatggttcattataaacatactgtttagttccagttaatgccatcaaacccgaccgttgcttagctggtagtatccatttacgaagatgcttcttaatatatgcaatcgtcgctagtggtccggttaaatcagcacttacaatttgtagcggatcacgctgcccaaaatctgcttgaagtgccgtgattaattctgaaatattatcccgaatcaatgcctcaatctgatttaaaacagtcacacgctcttcataggtcattggttgcgcacggtcatactgtgtcttttgcaagttaaaaatttggtgcatctcattaattgtagtcatcatagctatcctttttaatcgagcaatcgtttaattatagacaaaaaaatatcatgttctgatattttattttttcaatagtgcattcatacacatcacaaccacttgatcgatcataattgtcttattatcaatttgacgtgtttttaaggctttaacaaacaaaacaattggtgcgtaaacaaaacctaaaataactgccggtgaagaaatgacaaattcaggtgtatgtttgactgcttcaaaaagttgctcgaaaccttgataggattcctcctttttgatttttaagctatcaagaatgggcgaattattgaattgttcaataatcattaatgcttcgtaatattgcatgccgaaatcgtataacgcatacataaactgttggacaaacttaactgagttattgggtttggtattgatattttgacttaaaaatgctgctaactgtcgctttttagcaagatagacctgctttagaagatcctctttatctgaaaaataaacgtaaatagttgacgaagaaataccactcgctttggcaattttggacatcgaaacatccgcaattccctcttttagaataatacgacttacttcatcgataatactcttctctttgtctaaatctttttcccgcatatttggcaccctcttttaatcgattgaacgttcgattaataatataaaactatccctaataaatgtcaattaaaattattagaaattttatggatgtggcacctgtacgcaaaaaatcactagctatatatacctgagaatctacaatcagcatcttggggattgggtatactcaaaaacggcaagcctttttgaggagcacctgccgcttactttgctattatcaatcaattgagtatagtgataaccaggctatttcaatctagccttaatatcagcatctgaaaaatcgttgctaccgtccttttttatttcgccattatttaatggtaattgcatatctatatactgcttacactttagtaaggtaactgtaattctttgcagccttatctaaactgttataaatacgaccatcaaaaacagattagaattcctattcacctaataaatccgtaactattgaaaaacaaattttagcatcacttatggtacggacttcccacattaatcataaacgcccgataaacctgctccgacagcactaaccgcattaattggtgaggtaacgtgaaacgcccaaacgaaatctgagtatccgcgcgcttcagcacttccggtgataatcccagcgaaccaccgattacgaaatcaatatcactgtgaccatacgtcgttagtttatcaatttccgccgcaaattcttcactcgagcgttctttgcccaaaattgctagcgcgtatacgtaatcgcgatccttgatcttttctaggatccgttggccctctttggccttcacattttccatctctgcgttacttaatgactctggagccttttcatctggcacttcaacaatctgaaattttgcaaatttactcattcttttcgcatattccgcaatcccctgtttgaagtatttctcttttaatttcccgacacagataattttgatgttcataattgaccgcctttacacaagttattaacatagttatccacaggtgcataactcaataatcaatatattgtgttgaacaccagttcgccacaatatttatttagcctcgttttgtcaagacctttccgacttatccacagttttgcacagcaacacttgttcgtggattccggttacaaatcctattatatcaagaaccgaggcctattaaaataactttttaaaattaaatccacaggccagtccggcgcctgtggataacttttaaacaagcttcaaccccgtggttccggctgttcataaatttcgactaacgcggctaaaatttatcaccaaagttatccacacttttgcacaccatcaaattcgacaataaatgctttctgctatttcaaccagtttgttcggcttttgtcgcaaccattgccagctttcgcaaatttagtcgattattgaaaatcgattcttcgttttttcatgatttcagctactaacctaaaaaaacgcccccgactgctttatccagtcagggacgtttatgaaattcccatttattagttactttgtttagttaacgttttggtagtttccgtcaacttcatgttggctgtcttgagttttccgttatggtagtatttcaccgtcacggtatcattaaccgaatgggcatacagggcactccgtaacgtggctaagctggtcactttcttgccacctagctccgtaatcacatcgtacttcgttaacccagcagctttagccggtgaacctgagtacgtcttcatgatgacgacacccttcgtcacactggttggtaacttaagaacagacttctgatcactagaagaaatattggataggtcataggttgcaacccctaaagccggccgaacgacttcacccttttgaaccaattcattgatgatcttcacaacttcattacttggaattgcaaagcccatcccttcgacactagtcccagaattatctgaggccaacttcatcgagttgatcccgataacttgtccagcaatgttgaacaacggaccaccagagtttccagagttaattgccgtatctgtttggataaccgtcgcgtaccccgtcgtttgaccagatgtattcgtcgtcgccacggtccgcttcttcgctgaaatgattccttgcgtcaaggtcgttgcgtaattagagcccatcggtgatccaatggctaaggccgtttcaccaaccttgatattatctgagttaccaaagctagccgtcttcgttactttagaagaattgattttcagaacggccaagtcagtcacagaatcggttccgacaattttagctgacaacttagtcccatcactcataatcactcgaatggcacttgaaccactcaccacgtgattattcgttacaatataagccgcgtcaccgctcttcttatagatcaacccagaaccttcactgtactcttccagcttactagagctagaatctgaactggatgaactatcactgccagacgagtcatcgccacccaaaataccactccaactgcttgaagagctcttcttttggagattaatgaccgatacaacggccgccttgttattttcaaacaccttggtcgcctgtgaactgacattgaccttaacgttcgtcgttgacgttgaccccgatttattagaaccagttggtacactggtcgatgacgttgcgatgttattgttttggaaataattaataccgccgtaagcaacaccaccaccgattaaaccagctactagtgcggttactgcgactttgattaatgatttattagccataattgcgcgtcgaaacgcgatccctccctactaatgcttattttaagtttattttagcgaaaaagtgtgatttttttatgactgaagcgttgtgaaacattaaagctaacctataacgtgattaacttagtcgcttgttctggctccgtatcgtacaattgaaaatcatgctcaacgccaaaatctcgttccgtcatcatggaagcaaccgttaaatgcgccaaggacttcaagttattatcctgactacgatgccctaagtaaatccgcttggtatgccggccaatcacatccatcaaggcgttcgcaccatcttcattcgataaatggccctcatcaccaataattcgctgctttaatggccatggataccgacccatccgcaacatttctaagtcatgattacattcaaataaatagccgtcagcgtctttgattacaccttcaacgtgctctgaaacgtagcccgtatccgtaatgatgacaaacgattttccggcatgatgtagttcataaaattgtggctcggccgcatcatgtgacacactaaatgattccacgtcgagatcacctagtccaagcgtcgtgttcgggtcaaagacatgacataattcggcaggaacgttgccgattttatgcgccattgcgtcccaggtcccctgattagcataaacatccataccatacttccgcgctaaaatccccgcagaatggcagtgatcagtgtgttcatggctaataaataaactatcgacttcattaatatcacgatcgatcgacgccattaaattagcaatttttttgccacttagccccgcatcaaccaatactttgtgctctggcgtttcgatgtacgtcacgttacccgtactacccgatgccagaatgcttactttcatatcatccgttgctaattttaataccattatttaggctcttcctatctctgaaatccattactatcttcatatgatacacgcttttagcggggttgaaaagcaagccacctgcaagtgctcaaacttaacgtccacgactgtcgccatcacgcggttagtctagtttactgtcgtgtatgcgcgcactagtttaccggccattaaactcacacgaaactgcgaatatcaacgctgagcaatccactctacgtcatggcacctcaacattggcgtatcacaactagtcaaaaatctagtcaccaaaaaacgggcctgttaggaaaaacacccttcttcacagcacccgttattcgacaacgacacctagtcgttaaactggttttcactaatcaattgcattccacatcattccgaccgtcgcatctaaaccactcgtatcactagccgtactaccgttcttcattgaagaaccagtaaaggcattgatacggtgcagtgtaacgttagaactattcttaccccggaccgcaaagatccacgttgggacgtaaacactactatccttcaatttcaataaccgagaatacccaagctttgcccaaacgatccgggaactacttgccacctgattatattgatacaacgcaaccagggcctttttttcactgatcgtaacagccttttcgcgcaaagttttgacgtgattgacgtacgtctgagtataacttgtcagctgcttgtttttattaacaaataggtggacttgcccagcgccagtcatgatctcgccatccgcaaccttttgaacaaaaacgtaatcgccgttagacgacaaatccgcatcgtagacgtactcggttccatggattacattggtccgctgactcataaacgtcgtcaagtccgctttaggattgcgggtatcgatagtggtggttgcccgtagtgtgctcacgatcttaccgccactttgcacccgggctgtctgttcagttaactgactcaacaattgtttgagaccactctcgttactgcccgcaatatagtaacccgtcccttcgctcgtgtccgggtttttaaagctaatattatctgcgcgcatttcacgaattatcgtggtcgccgtatcaccagtcgtttgtgtcgacttagagctcgtttgcacgaacataaaacccaagaagatatctagaacaacaaatgctagtaggaaaatccactcaattctccgaaaattcatgcggccacctcctaagatccacttaacatcgacgtatatgtccgccaagtgccattatagtagacataatacgtcggcgtcaggtcgatcacgagtttggacgacttgttctgtgaccattcgtagccaagttcaatactgccaattttactgtctttataaccagcggccttcagacgttttaacacacttgtcgaactcggtaaagtcaccgcttgcttctgaccagtagttggtactggcacctgcaaactgtacagtgagaagtagtaacggtctaacccgttagaagtgagctgaatccggacatcgccattttcggtctgattaaagatcgggaacccttcaacatagcttcggtaaatgacactattactcgttgcgtcaaaaccgtagtagcggatattatccattgggacaccgagattagttaacaaattgaagctcttctttagctgattagtcagtgataggctccgcgtggttcctgaatcactataatcttcgaaatacactgttcctagcttagaatccaccgtcatgcgcttgtaactacccgttgtatactcctgcttaccactgcgattatgcactgaaacggtcgaattaccatccgcatctagtaatcggttggcaatctcactcgcagccgctttactcatcaagtagctataatgttgcatcgtaacttgctttggataatcaatatacgttgtattatcctcataggtcatcttgacagcaatccgtttgaccttgtcgactgccaaaacttttttcaacgacgacagagattttttcttcaaccgaacactataaatctcatgatggtcatcattcaaaaagtagatgtgattcgtatcattgactggaatcacgatccgactaaattccgaggagcgaaaattactgagatgttgcttgaagaccgtattaaacatactgacagtaatactgtcaggaaagttcaatacgtacgaatcagttccatttaagagcgcacggtagctttttgccgacgtaatgcgaactttagagatactccgcgcatcccatttgcgtaactgctcactaaattgactgactaagctgacatttttattaatcagcagggattggccaccctgactgttagtgtgaattaattgtgtcggtaaataaatatcatcgattgtccgagttgtcaacgaagagttcgatgacgtcgtactaaccttgctttcatgctcatagcgtgacggattcaaccagatatacatggataaaaccacgctcaataagatcagaatcgtcaataaaatgggtaagataaagcgtctaagcttgtgagtcgtcatcccaaaggtcctcctcctcataaggttcgtatggcagggagatatagaacgtagaccccttaccttcaacactatcaacccaaatacgaccgccgagcatctgaacaacttcttttgaaatcgccaaaccgaggcccgtcccaccttgggcccgtgaccgcgccttgtcgactcggaagaatcggtcaaagacgtgtcctaagtcggcccgtgggatacccaagccctgatcactaatactaatgatcacttggttatgcgtctctaacaggcgacaagtcacgacaccgccatcaggtgaatacttgatcgcattattcataatgttatccaatacttgagtgaatttatcggtatcaatttcaacccacagatcacgcttggtaaactcgcgcttaatagtgtaatacttagctggattatcatccttctttaagatcatatcaaaccgatcaagcacgtaattgaacatctcattaatattgaccaattccatatcgacccgggtggtccctgagtccatccgtgatagacttaagagttcattgatcattcgaatcatacgatcggtttcttcttgagtgaccttcaaaaatcctggggccacttcaggatccttccacgcaccatcactcagtgcttcaatataactccgcaaactagtcagtggtgtccgtaattcatgagacacgttcgaaacaaattgtttccggtcattatcaatcttttgttgttccgtgacatcgtggagcacacagactaacccactaataaacccagactcccgttgaattaacgagaagtaggcattcaagattaggtcacgctcgttcgaagaaaaatcaagcatcaattcatcttgattttcaatcaaatcacgcaatgaataatcatcacggatttttaaaatatctaaaatcgagttaccgattgccttttcggccgtaacatccataaagtccgaggctgtttcattgatgatggtaatattaccccggcgatcagtggcaatcacgccatcactcatgtgtgagagcacactatccaaccggcgccgctcagcttctgtcgactcttgcgattcttccactcgaatcgacaagttattaatggctttagccaactggcccaactcatcatcgctataaactcggacttgccccgcataatcaccacgggcaattcgttgcgtctgctgcttcatttcttcgattggacgagttattgcccgggcaataatgattgcaattcccagtcccaagaccatcgcagcaagtgacgcaatcacaaagattcccataatgttgttaatcgtactgtagacagacttcatatttgcccgtacatacagtaccccaactaactgactgctattacccgctgaattggagctatatagcggcacgattgaaacgtagtagcgtccattattctgagtgtcataggtacttttagtgtaagttcgattattatagatcgcattcttgacgtttcgatcggtcgttttttgtccaactactgactgatcattaacatcactcgtcccacgaattgttcctttgctgtcaacaacttggatttcatcaacattcgtattgttgtagttcgacaaaatcgtcttgatttggccgttggccttgcgcgtactgctgacggtcaattgttcggacaacgaattatcaatataagttggaatttgcaccgactgtttaaaatcctggatgttctttgattccaactgtttcacaaagattgcacccacgatttccaacgtaatcaataatagaagggcaaacacgagcgcaattttgaaattaattgttttaaaaaaatttttccgtttaaatctcaacacggtttagcaacctctactcattttcaggattgcggagatagtaacccacgccccgccgcgtcaccagccattttggatgactcgggttatcttcaactttttcacgtaaccgccgcacggtcacatcaactgtccggacatcaccaaagtaatcatagccccagaccgtctgcaacaagtgttcccgcgtcatgacttggccgatatgttgggctaagtaatgtaacagttcaaattcacggtgcgttaattcgatgttttcaccgcgtttggaaaccatataagcttctggatggatcaccagatcgccaatttcaatgtctgaattttcttcaacttcagctggttgggcacttggtgcaccttgccgccgcagatttgctttgactcgagccacgagttcccgttttgagaacggtttggtcacatagtcgtccgcgcccagttccaagcccaacaccttgtctaattcagagtcctttgccgttaccatgataattggcatatcatagttcttccgtacttgtcgagcaacttccaagccatccatcttaggcaacatcaaatctaacaaaatcaaatcagggtggacttcatccactttttgtaaggcttcctctccgtcagctgcaacgtgaacttcatagccttctttggtcagattaaatttcatgatatcagagatgggcttttcatcatcaactactaagatttttttcataacgattcttcctccttaggggaaaacaggtttacatttcaatttttagggtgattcgcgatatattacgagaaaacaggtcctttctcgtgtcagggttggttgaaactaaattcaacactggttttagtatatcacaaatgtagttggctttctttgattgctaatccgcgtggccgtagtatttcccgggaaatcatttgccagttcaagcaatcgttttcaccaattaattactcaaaaaatcactttttttgaaaaaactttcgaaatagtgttgtcagaactcaaaattcatgatattatattttttgttgagttatgggcagttagctcagctggcagagcaacggactcttaatccgtgggtccagggttcgatcccctgactgcccatcataaaccattaaccagttttcatgcagtgtcaaaacaccgtgattgctggtttttttgtgttttaaatgcaagtaccgttatcatcagttgtcatattttttcaataaaagtaagccaattagtaagccagaaatataacaaaaaaagccactgtttccagtgacttaatacttgcgcggggcagtgactgttagccaactttggttagcagtttttttaatgcaaaaaaataaccagctcataactgagttggttagcaatgtcaataagatttgctgggattaaatttacaaacttttttactataatccttctgattatgagcctcgtcagggtatataagatgatgtgggtctaaaaaaagaggatatacattttcactatcatcggtaaatgtaataactgctagtagccttacaccttggccacaggaaagttgccaaatttcagttccgtcatctaaatccaagttgttgtgaagtttttttattatttttgtcgctagctctcttttgtctccactcagaagatgacaatgtttttcctgttttatatctgaacccttttcctttacaaagggcaataacctatcaactaactggtaataaactttcccaacttcacttttatcgtgatactcgttagtaaattcgccgacccttaagctgtgagtccaatttttatatgaatttaactcaatgcttacctcgttagttctttttttaaagttataatcagcttttacattctttttaggattagttgaatttgaaactcccatgattatgcaactcttttaatatagcaatcatagatatcacgatcactaatttcttcctggcataactctattggactatagccattccttgcatttttccatggtgtctcttgatgtgtcatactctccaattcatcagcagtatatccaccatagacatcattaacttgattcaagatatcttctatatcagcagatactttgggagattcttcccccacatatttttcaatatcatggtaaccatagtctgcatattttgcataaatagaaggtataactggcccatgaacccaagcttcaaattcatcgtcaaaaagtttgttttttaaatcactagaattatcgttcattaatgttaatacccaagagtaagcgtaatatatcattttttgtagtttctttggtgacatacttgatcttgttaaaaaccacttcgctattgtatcagcggtatactcctttgccatgtgaattcctccttgtggaaaccttccttacaacaagaattctaacatacttggaacattatgaataaatctttttgaacacttctagcgcctggttctttaaatagttaaacttgctaacgctaaccgataattgttcacaagcttcgttgcggctgaatcgtttctcaataatgtaatcatgtaagataaattgatattgtggatcatcaattgcattgagggcgtcttcgacctcttttagctggtaagacaggtcaacatggtttatcagacggctttcagtgccgtttcggctgctatggcttgatactccatcgaacgagggactagaaacttgattaaaagccgtcaagtcacgttttagtttggcatattgctttaataaattacgaatcttcttaacatcttggcgcattggaatcacactttctaattccagatatatgtattaaaaaacggggctattacaccccgtcttggctaatatcaacacaatgaatacttatattataacacttaaaacaaatattttcacttataatagtttcacatgaaacatattcactttaaaacttatccggttactaagccgcgcaattgttggatcatgctgacaacttgatacggtgtctttgtcatatcggttactcgattttgataccagaattgcgtcagcaaggacaccgcaaaatcgtactgtttatagacagtcagatcttcattcttgctaacggccgtctgcacgtagtccttagcggcgtctaaatagcttttaatcattggatcatcttcggtcacatcaattcgcaggctcagtttaatgtcatcaacggttacagccatgtaatcactcctttttaaggggaggtaacgaatcgtgccccccttagttttaatttatgtatagggggtgtcaatttttagacacccctttgtatagccgtccccaaaagtgggtacgattatttaccagcagttgcggttcctaacgccacgttgattacagcggtcttatcaatcacttcataatcattccgcacaatgacggaaagtccttgactgaactggtcgaacttgtcccattgggcagttacttggttacgccggaaaacagccacggcttgtgataagtcccccgcaatcattgggaacgtcccgtccgcgttgttagccagtaatttatcactgatcatgacgactggtgcccctaataaggtgaaaccactgggtgccgttgggttcggctgtaataagtaacggccttcggaatctttcaaggtatcaaggtaattgaacccggattggttcactagccacatcttgctcaaagcgggatctaacgtcacattgaaaatctttttaagatcatcaatattggcagccgttgctttggtgaaactggttcccgttaacaagctcataatctgcgtgttgtccgtgttatcaaccaattgttgtaattggtttttaacttcgccgacaatatcaacttcggcgtcttccaccacttcattagataaggcaatcttacccgcccgggttttcacatcaaatggcacttccgtaaacatgttcgcgtcaacatcggcaatgtccgctagttcttccttagtagccaataccgcagattgtcggctagtggcaattggataagtcccggaaccactagaaacctgtttaactgttgcatattgggcaagattgtaattggattgctttaattggaagacgggagtaatcagttccttgggaataacggcactggcaccactcgtattcaagccgtctcgggtttcaccgtggcttcgtacataagcttcaaaggcaggaacaccggtcttgttgtcatcttcattcgtgtttggatcaataattgtttgctttgccatattatcaggctccttttcttgattgataaatttttcgtaactacgactttcaatttgaattacttgctgaacactcgactgtccataacttggaatagccgtagtcgttaattcgtataagtctttgatatggttgaccgttcgggtaacttgaccgctcgcagtatcttgcgtccaagtatcatcgccattgtctaaatcaaaggtaaatgagcacccaccgattaccccatttttaatattgttatacgtatccatcgcataactaacgctagggtctagctccgccgtaaactttaaacccgtatcatcaacgctcgtggtaagggtgccgttgtcggcccgggctaacggttgcgcccaattatgactattcaataggactaattttgacaaatccaagccatcaagggcggcgggatcaatcatttcaacaaattcggtgccatcattcgtactcattttcaatgaggggctattgaacaccacggcataaccagaaataactggcttgccgtcaacttgttgggcttgcgtggctggttcacctgaattggactgatcctgattttcgggttcggttggggcggcgtcgcgtttttctgctttcagttcagccgccaaggtaaatcgttgcttattcttcactcgtattcactccattcttttgtaagtttaagaaaatattgccatcgtcagttggtggcaagccaatcttggcccgagcttcgttacggctaataatgccgcccgtgaaaccggccaccgcttgggattgttgcgtttgtgggtcaaggctcaataacttgtccgtgttaaacgtaaagtcatgaccaagtttgaacgacagctcgctggtgaagctatcaaagtaatgttgcaacgtcccttgtagatactgcacgccactttgctcttggttagaatgatcgttctcaacccctaagcgctccggtggtaagccaaaggctttagcaatttgtcgggtcgtccagtcattcgagttgaccagttttaacacatcggtatttaaggataagttactaatatccatcgtgtcatcggtcacaatcgtgttgatcgcgttgtcacccgtattggcttcatcaaactggttgcgaatattgcccttagcttccggccctaaatcagattgatggactttaataatcgtggtgccgtgcacaccagcagtaaaaaaaccggttagcaatttattgccggccgactgaatctggcgttcatctttgagggcatataggggactaattcccgatacaccatctttagtaaaatatttaaagtgcaaaatgttgttaggcgcaatctgacgaccgctaccaccaatcggcgtataagtataggtcaacgccccactgacgtcatcttgttcaaccgtcaattggttattttgcacaaatttaagtgtgtgattaggcaaaatctccgcaaaactattaccatttagtaacaggttggccgccaacgcatatttgaaatggtagccgtccatttggctattgggggtctgattaatcatcgtgttaaaaatggccgtatcgcaaacaatcggattgctggcaatatcgctcgcaataatgttaattgccgcgtaaatgtcactattacgcaacaccgccgcactcacaaacgtatacgggtcattgcttgataaactaaccaaggcgtcagctaccggatcatgcgtgccgctggtgttactgcttttaacgaaaaaactcatttaatcacctctttgcttttcataattaatcagcaaggccagtagaatcatggctataccagccaatattaaccccgcttgccagctgatccagcaaccaaaaccaatcactaagcagattaagccaagtaccaacaagatcgtttgcacataatcagaacagatccgccgcagtcgctgttttgtagtaatcttctgcatgttggttcgcctcactttcttgataatattccataccggccacaaacgcgttaatcaacgccgctatcggatcaatacggttgctattgcgtgccttatcaagttgccagccattgtttaccactttcaagatggcgttattgaccgcataagcgagaatcttattgccgttatgtttaatcttgccatcgtaaagttggtcacgaaagttacgggtgggaatgttcaaagtcttggtgccttgccgcacctcaaacaacggataattaagtttttcaaattttgtaattaacgtttgcgcgttatacgggtcataagcgattgctttcactttccagttgtatttcccgactagtttttgaacaaaatcaaatagctcatcataatcaatcacaccgctatctaatcgggtaatgctacactcaccagcgcgctccattaaccggtaatcaatcccatcacgcttaattttagaatcgagtccatatttttttccaacaaatgaatgactatcacaataaaactgaccgttgccaattggtacgagccaactaaccgcggtgaggtcgttacttttcgataaatcaatgccaatataggcgtcgcgattatgtaagtcgggcacctttaccaatttaccagcggcccaatcgtctgctgaaatataactgtcctcgctggcttgcaaccacatattgaagttcttaaccagtaccggaataaggttattttgcttaattgcaaggtcaacatcggcctgaattttctccgtcatgcgttccctaacgtgtggttcactgaacaacgggtttgccttaatccaattggcttgatcgtaaacttcttcgcggtcgtccagttcccatattgccacaaaataacggtcagcttctgtcttaccctttaaaacgtccgtcagcatgtcatactcggcgtgcattgggacattaaggttaaggcccgaggtggaaattaccgccagcagagaattatcctcttgagcttgaccagacttcaaaacgttgtacaccttgcggtctttagcttcgtgccattcatctaaaataacagtagtcccggcataaccatcaagcgtactggtatcactggcaagggccaaggcttgcgaatcagtttctaagtcagtaatggcttgcttctgtaccttaatccgttgccgcatgtacttcgattgcttacggacttgccgtaacccacttgaaagcatgtcgtagcctaatttagcttgtttaagggcattgctgacgaataatacttgtcggttgcgggcgggctgacgttctcttaaaaggccattagcggccataccagaagccagataggttttaccattttttctagccatgctaataaacgcacgatcataacgccggttgccagttgctttctcccgccaaccatacagctcactaataatccatttttgaaatggttgcatggttagttggctaccgtcagtcttaggcattaattcgataaatttaaccgcttgtgccgctttgtcttcatcatagtagaacgggaagctagtttccttagaacggcttaaatcgcgtttaaatcgctcacacgcccatttaatcttttgacaagccagcacttgacccgacaacacttggtcaacatattcaatcatgacaacatcgcctcgaaagtatcttcgggtgtttcatctttttgcttgtttaattccatgcgcgcccggctagataacgacattcctaaatcattggctaaggcttttaaatctttcatcgcttgtgactgcaaggccacgtaagggttcggcttacgtacgccagtctcttgattagtttgtaccagcccgttcttacgaatatcattctcgcatgtctgtacggtggcataagcgcggcaataactggctaacatggcccggtcaagttcactaattggggtattggcctttaaataaggcgctacccgttgccattcagtcaaggaccgatcatgtaaccaatcagggggcgttaaatcgagtgacgggtaatcaaataacgctttctctgcgtccttacgttggtcacgctcatcattggttaaatgttttttcatactagctaaggcttttacttttcggctcattcggagcactcctttcgtttaaatttacgtaccaaaaagcccccacgggttagacccatagcggctgattgatacatatatccagaatccgtttattatatctatattatcgcacatatctctaaaaagtgcaattaataacatgtatatatttacacgttaccccctgactgactatttgttcaaatttcgcattattagtagggatatttcacaatccagcaaaatcagcaaaaaatcaaagttaaaaagggacttttataaacacaaaagtctgggcacgctccttttttgtcgaccacggccccccccatatcaacgtttctgggctgtcatgctgttttgaattagtctcgtggcgcaaaattgagccgccaaattgaattgttcactcggccgaaaacttggagcagtcaattgccacttttggcaacgtagacgcaaaatgcgggttggttaacaaggtcgaaaatttcgactcagtagctcggctgaaagttcagcgcagtattgcgcatatctattgcctaagttaagcttagccagtctgattcacttagcggaaaactccgctcacctaaaaagcgccgcacctttaagcacgacactcattggttatttagtttgttgtttccgttgttctctagccagtctagtcttccggttatggtgtcggtagcacagtggttgcaagttactttcatctaagcgacgtgaccagtcgtctttgatttcgataacgtgatcgaccacatcggctttacggatcacaccatcttcataacacttgatacagactgggttaagttctaagaaccgccgtgacaacttgcgccatgccgaagacttgtagaactgttggtacttactctcatctgaatcgtacatgcgtttgtgataccgccacttgttagtcgcctggcggtgtttctcgcagtagcgtgtgtcataagcaactagcgtccgacaacccgggtgctcgcactgcttcattggcttagccatgaccgttaaccttagttagtgtgaccacgtcataggcattcagttcgccatcagaactaacgccagcaaccttatactcaacaccatctagcaacgctagtagtgctgtggtaatacgttcatcatggcgcaccgcaattagctggttagttgtcgcagtcgtaccagtaaggctaatcgtgttactgatggtcaacgtatactcaccacaccagacagtgaacagtggcacgaattgttgcttggttgtgccgtttattgggttctgaacagacttgacggtgccaaactgtacccgctcatttaggcggcttagattatagttcttcatcttcatcaccagtcctataaaccaatgcttcgcaataaatcacttttgaatcgctcaccttaataaaatcaaattctacatctaacagttcgtcatcaatatcttgtgctttgtcgacttccgaaacttgtgcaaataactcctccatattgtcagcatgtaccatcttaattttcattatttaagctccttttattctctaaaatattgcttcttaactacatcaacaacataatgacttgctaacaggtcatagtaatagtagttatatgtttccttgctcataatcattactagtgaagactggccgggataataccaatctactttgctatcaaatatcacgcccactaaatcaagcgacaagacgtgctccgctattttgctatgaacgctatcggccggcccataatcatgagcaattgcaacaattcgtgtagttccacttaccttttgcaattcggcatgatctaaccattccccaaggtaaggtggtgtgtcatacttattacccgcattgtatgaacgctcaccagctaacagtttttcaagactatgcgggcgttcatacacggcacatttatcaaacttaaatacgtcttcaaattttttgaggttttctgaactgctatattttgtgtctctcaataattgaatttcttgccatttcatacgtgttttcctcctagaactggaaatgttttttttaacgtggtccaacgtggtccacttggtaaattgctgattaaacttcgcgcatatacccatgtagacgttggccattcattctcattcgttgacttttccaaccgtccatattgtccattaacaacttgattcgcttagcttccgagtttgttcgcccggttaaataacgatcaactgttttatggaagacaacttccataatttcccgagttgttgtttgattgagtagtttccgttcattactaacttgatcttgtaaccacttagattgctgaccgtagtcactaacatagctttgttttaagctgatactcatattttcccagtctgtgggaacttccattgctaaaaacgcttcgatggcatctcgcatagggtcaacagcttccgcagccatctggtacgccttagcctctttcacggtggcctgatccagatatagcggttcgccattcctaaaccagtacacggcctccgccaatacttgaagcatgtaattctcgtccgggtgccatacatctagcttagccttgttgaccccacatttaattggatagaagcgccgttcaccggtcgcgtcctttaaatagtcggtttggttagtcgtgccaataaatacgcatttacgcgggtgtggcaacgcatagcggccgtaactattccgatatgtgtcggattgtgcactaataaaatttttaattccctcaacgtccgtttttttcatggcggaaagctcggcaacttcaataatccaactaccttgtaactgttgataatcgtctttctgcttacccattcctttcaacgaatcattgaatttatccgggtatagattcttaccagccgtactcttgccaagtccttggcttccctctaagatagggacaatttcaaacttaactccgggaacataggcccgggcaataagaccagttagccatttcttagtgatggtgcgggtgtagtgattatcttcggcacctaagtaatcaatgaaataacgttcagcacgtggctggccgtcccattctaccgcttcaatacgagccttaaccggattgattgtcttgcggcgtgcttctgtaactaccgcgtcggtaatgttttccttgctgaataacaagttgtaatgatcttcaatataacttctcaataacgtgtcatcactatcattccaaaaaccttttttgaacagtgagttgtctgcttgtggtgttttgacaatttgttccgagaactcgtcaaagacaactagtcctttcaacatttcgtcatgttccataattaaacggatattgtaaagagactgtgttttgatcccatcgtccgaattttttttgaaatcattctgccaatcagcgtcacgttgcattttgataacattattggccgcttctcgggtctctgctggtaaatccattgctttgcccattaatgaacccccttactctctcgttttaaaatggattgaaaaattacattaacctccttgcttggtagtgccggatcaacgaacgaatcattgatcactgacagcatgttatagactgtcttgggagaagcaccgacgccaaacatacgaccggcaattttagttaaccaagcattgcgattgcctttggccgtcccggttaccatttcatctaacaagcgaccggtatacttcttttggcgtgtggtataggtgtgttctgacgaccagttcactttttggcctgccaacttatcgactagccattgaggagccggcttaatatcagccaaggttcggccatctaagggggcatacggtttgccgttaatctcgcttggtgcgatcactgtgaagtcgcttaacaagtcaattccgggccaaacgtcaattttgcgaaccttatcacccgcgtatttcaaaaagtaatgcacgccgccgttagccgtccgttcaatgtaagtatcttttggcaacgtcagcccttgcttaaatagttgtaccaagctagtccgaccgtttttagttggctcgtgcatatcaatgtcaacaaccaataaatccgataaatctaggcgcaagcctaagttataagccgggtgatttttaaaccatgcgaagatggtgttctggtcattagttgcgtctcggtagccggccacccctttaggtggcttctttgtattctcaattagtgggtaaaccgcatagcctttttgggccagctcaattgctttatcaagcgttgcgaactctttcattgttcagcaccgccaaacgtattaaggtcatcaatatctgtatagtgattttctgcatattgctttatgacagtgattagtccactcaatttttcggaatgatcaatatttttattaacgaagtagtcatagacaaaatcatctaaagcatctattgaagttacgagtgatccagcctcaaacactaattcatctaaatctttagttttcttcattacaaattcccttcatataaccgtgctaacgtgttaaaataagggaaagcatatttttgattagttctcttcgacctactactgtccaaagcaaagtaggtcttttttgtatgctttcccatgcgactgacctcacactccaaaataccgacgcgggttcttggctaacttaaatgccacgttgccaacaaacgacacaatcataaatttgattacccataaaattgctgttgctatcatgaaatcacctccttaaattcactctgcccccgcacggtacaattaaattttatgtgcttccatgaacttatcagcgtctagttggtcaatacgttttgtaccgttgattgcaactactcgtaaaccctgcttaatatatttgtaaagcgtgttgtatgacttgatatttaagcagtccatagcttgcttatatgtcatataacgtggcaattctttttgcatgttgttccgcctcccttaaactccgttatgtggtataaaaacataataaaccccaatttaacgttttgcaagtttttgaatgaaaaaaactttattttgaagtattttcgagttattcttactaaaggaggtattcttatgtcactcaaaaattcaaatgaagatataggtaatcgaattgctaaaataagaaaaataaaaaaaataaagcaatcagaattagcacaaaaattaaatattccaacaaatacgcttggtaattacgaaagaggtgacagaaccataccagcctcattcattccaaaggttgctcatattttcaatctgccttcctggttaattactgatggaataccggaaaatgtcaatgactactacacttatgaatactttattaatgcaaatgatgatgattggcagcaatattatgccgaattaagcgccacaagatcagcagaaattgcttcagaaagtgctgataaaacaacaaagattatcgagtatgttagatctttactgtatatgaatgaatttgaagaaattgattatattctagactttgtaaaacatgacaaaacagcaatcacaaataaataccgtctcgaaaaaattaaaggtaaccctaccgacatttcagctttgaaatataacccctttgaagaattaagaaaagaaaatgatagtatcaaaaagaaagattaccgtttgtggttcaagggaacaatcgaacacgatttaaatgaaattgtgcaaaacctagatgatggatcaaatttaaagaaaagtctctcacaaatcctcgaacgtattcataaagaacaccaagaagaaacttttttctaaattatcttctttttcttacataacactgcccccgcacggtacgttatggaggaaattataaatggcaacaatcaagaagtatcaggacaaggacgggaatacccgttatcagtttcaagtttatttaggtgttgatcctcaaactggtaaaaagaaatcaacccggcggcggggttttaaatcaaaaagtgctgctcgtattgctttatccagaattgaagtagagttacagcaagaaccagttttaccagttgataataatattctctttgttgacgtttatcacgaatggtacgaccagtatattaataccgttcgtgaaagcacttgggcaaggactgctggtatgttcgataatcacatcttgccgttgtttggtaacaaacggttacgaaccatcaccgtcaaccagtgccagcgtgctgttaatctatggtttaaagaagtcacgtacaattacaagcgttggtacaattatctggtatcagtctttgaatacggcttaaaacacggctatatcacacataatccagctagaatgattacaatgccggtcaagcctgatagttggggtgataagcccgataacttctgggatcgcgatcaactaaagacgttcttcaagtgcattgaccagcaaaaagaacccgaaaagtattgtctcttccgggtactagcgtttgcaggcgtacgacgcggcgagtgtttagccctgacatggcaagatattgactttgtccataagaccttgcgggttaataaaacacttacccaagggaaacgcggcaagcagattattcaagcccctaagacaaaaaagggccgccgcactgtcagcttagaccatacgacggtagaaatattacaacgctggcataaacagcaacgtgagtattatttgtttttaggttttaatacgttacagccggatcagttagtttttgctaacactaagaacggttttaaatcgcttaatactccgggtaagtggttaaagcggatcatcactgattaccacctaacccctagtattaccgtacatggatttcgacacagtcacgcctccgctttgtttgccgctggtgccaccattaaagaagtacaaacccgattgggccatgaggacgttgcaacaaccctaaatgtttacacacacgtcactaagggccaaaatcaacaggcggccaataagttagccaattatttaggcttctaaacttggcatattcaggcactttttaccaagtggaccacgttggaccaccatatggaccacgtcaaggggtctttgaagtgctgatatatcagcgtttggaccaccggaccacgtggaccacgttaaaaaaaacattttcagttctagcaggaaactgggttattttaacacttcatagtaaaagtaagccaattggtaagccaaaggtaaaaagtctcacgtgaaacaccgcataagcactggtttaatagcgtttatgtttcagttgggttcaaacccctgactgcccatcatataaccacactaatcagttttcacgccgtgataatccaccgtgaaagctgatttttttattcctacaaaaaagcctcaggaagcacaacgcaaagtgcgtgtgacgtccctgaggctttttctaacgatctaatgtttaccatcagcgtagctaagtaactcaattgctagggttattcttgatcaatatggaaataaccttcaggagctgcactcggctgtgcttgatgccaatgttggctactacttccatatttagttggttgtggatccggtcccattgcaacaaagcgccggcccaatgcgtccataaaaataacgacccgctgatattcacgcgcaggtgcaactaacgtacaattctcatgcttaatgccgtaaacatctacaaaatccattccgaccacttagctttcttgtttagctgacaacccgtcacttcaaataaaaaccgaaccagttaatgataatggttcggcccaacagttactattgtggttgaacgttcgttgcttgggggccacgatcgccctgttcttcatcataagttactttttgaccttcatctaaggttttaaagccatcagtttgaatcgctgaaaaatgaacaaagacatcggtaccgtcttcacccgtaataaaaccaaaccctttatccgcattgaaccattttactgtaccattcttcattattagataagtcctctcagaactgactgcagtaacaacatcgttaaccttgggagcgccaatcaatcataacgttccacgcgttaagtggcttaagtatatcacatccctagtttttaatcgctgaaaacggtgtgcataacgtatgactttcccccatgattcctgcatactgaggtgtaaaggggtgactaagtatgcaacacacgactcgtcaggcagccctacatatgatccaaaccgcccccgtcttcacgttagcaactgttgatgcggacggctttccgaccatggtagcgctcagtcccttacctatcaaacggagcctagaagaactttacttctatactagtcgtcaaacttcaacaacgcagaacattcaaaactggcgtcaagcgagtttattctattaccaactgtcagactatgcgtcaattatgcttcggggaaaactctcattagtcggtaccaacgtttttgaacaagattggcgggctgaactaacggactttcagcagcaactaaattacaaagaccccgtcattctcaggtttcagacaagttcaatcaagattcgccagatgatgacgatcgaccatctcgaactcgttgatcagcccactgacggccccgctcacttagattagccgttacaaattgggccttctcagaaagacacaaccgaagcgccacgactagattctacgcaaattctagttgtggcgcttcgtgctttggtcacccaacaactagcatggctcgaagcgtgatatcactttcaaaccagttattaatgcaagcacgtccgacttgcatcaaagaccaagtatcatcagcacaagccagaacactttgttcattcaccttcgaaaacaacgccactttcaacctcgtcagcccctactttcatcaccaatatttgcgagtcttgtaaaaagagactaggctgtagttatggttaatatttttatatttaggattacttattgcaatttttaatgaccgaactaaggagtgtggacttatgaaacttattagattgcgaattgaaaatgacgcgatggatatcgcttatcatccagtatcggggcaagccgcaacggcccattacctgattgcctataattctgaccaaacaattggtgaaaatctagagaacatcaaggttcgcttagccggacttcaattcgatgctgctattcttgaaaacggactgtcctatccattctcagacacaatcgtcggtgtcaactatgatcgcattgatgtcgggctagctttgactaatttgcttaatatcccagtcgttagccaagctgccgttgatcaacttggactagcagccgcagttaaagctaaaagtgcctatttaaaatggcatttggattactacggccaataccacggtgtccgtaataatggtcaagaagccatgttgaccattggtaacggttattttggtctacggggcgcctttttggaaagtcacgccgacaaggacaattatcctgggacatacgttgccggggtctatgatcaaaccaccacgactgttcatgaccaccaagttaagaatgaagatttagtcaatttaccgaacgctcagttcatgactttcggtattgatcatcagactccctttacactcaacgaacatgatttacaagacgcttatcggagccttgatttgaaaacgggactcttgacgaccactaaattgattcagctcgcttccggacatcaactcagaatccggtcgcagaaagtcgccaacatgcgtgattggcaccgttacagcattcgttaccaagtcaccccactcaactttgcgggtagtctacaaatctataccgaaatcgacggtagcgtcgtgaatagcaacgttagccgctataacgtcttcgatcagcatcatctgaagactatgggcatcgaaacggctgctaataccgtctacctttctggtcagaccaaatcatcacatatcaattacacgattggggccaaattaactagcccagacgttcctgcaattgagaactttaatagcacgcaacaacctcagggcgttcagcaaaccgtttcactggcggtagaagctggtaaaacgtataccttcgataagaacgtcgtcattgcaactagtaatgaccatagtgatccccagttgacccacgtccaagccgagctcgaccagtccagttttgacaatacggtaaccactagcaaggactattgggaagcgacttggcgagccacggatattaagatccgtggcgatattacaagccaacgcttactgcgcgtcaatatttaccacagtttcgtttctgctgccgcaattgaaagcggccaattagacgcttccgttggtgctcgggggctccacggagaagcttaccggggacacgtcttttgggacgaaatgttcattttaccattctacacgttgcaccgaccggaactagccaaacaactcttagcttatcgttaccggcgactaccaatggcgcgtaaaaatgccgaagcagaaggctacgcgggagccatgtacccctggcaatcagcatccaagggtgatgaacaatctcaattcactcacttaaatcccattactaaaacctgggatccagataatagccggctccagcgacacgtctcgttagatattgcctacaacgtctggttttactaccacgttactcaggaccgtgatttcttaactcattacggtatggaaatgttgctatcgatcgcagccttttggatcagtaaagcagattatgaccaagctaatggccgttataacattagtggggtcatgggaccagatgaattccatgaaaactatccaaacagcacgaccgctggattgaagaataacgcctataccaatatcatggttgcgtggctctttgacacgattaccacgcttcgggcgcagatgccccaagctgcttttcaagcggcagctcaggccgcacaatttgactcaacggctgagcaagcgttaacgacgatcagtcatcaattaacacttgaaatcaaccgtcggggaatcattgctcaatttgaggggtacttcaacctaccgacgcttgactttcaagcttaccggcaaaagtacggtgacatcgcccggatggaccggatcttgaaagcagagtctaagacacccgatgcttaccaagtggccaaacaagcagacgccttgatggccttttataacttcgatgtcacaactgttcagaagattattgaaaaaatgggatatcaacttcctaaagagtatctgacccataacattcaatactatttagcgcgcacaacgcatggttccactctctcgcggatcgtttacgccgttttgaatcagcttgacgataatgacgatgacgcctggaagcttttctcagaggccctcgcatccgactattacgacattcaaggtgggacgaccgctgaagggattcacctcggcgtcatgtgtgcgaccttaaacctgacgacacggaactttggcggggtcaatccactaggtgcccacttacaggtgagcccacggctacctgaacactggcaaacattgaaattcaagcatctctttcggggtgttcactatgttttcgttatcgatcatcaacgggtaaccgtcactgcggaccaacccagcacgattatgattggaaaacagcattaccaattacaagctaagaaaccactttccgtcacttataccgattaatctaggaggcaatcaacatggttaaatttgcagcaatcaaggggtttgtctttgacctcgatggcgttatcactgacacatctacttttcatagccaagcttggcaccagatcgccgataaagtcggggtcagttggaatgatcaattagctgacgcgctcaaaggtatcagtcggatggattcactcaacctcattctaactcaagggcaccgagaaaatgacttcacaccggcccaaaaacaagcgctagctacggaaaagaacaccaattatttgcagctcgttaaccaaatgaccccagccaacattctaccaggcatcaccgcctttttgactgaattaacaacggctggctacgcattgtcactcgcttcagcatcaaaaaatgctccgcttgtgctacgtaaactcggtcttagtgactactttacgaaggccgtcgaccccgctagtctcaaacacggtaaacctgatcccgagatttttcggcgcggtgctgagattttaggccttaatccagctgactgtattggtgtcgaggacgcggcggctggcgtacaatcgatcaaaggcgctggcgaaactgccatcggtattggtgacccgaccgttttagcggcggcagatatcaattttaccgatacgactcagctcacactcgccaatattaaggcacaactaaactaacgtatttccattaaactcatcacaaaacaaaccggatttggcgaccacgtcatggctaccaaatccggtttgttttgtttaagccagtcgctaatctcaccagttggactgctcactggaagcttataattatcagactagctgtcaattctcaaatcaaatcaaaatgttgcaatccttgggcaatcccgccgtgcatgttgtcagcggtcacgtaccgcgcgagttgtttgacctgcggatgaccattacccattgcaatcggtgtctggatcattcggaacatctcaatatcatttaattgatcaccaaacgcataggtcggtaccttagttaaatgcgccttggttaagatatcctgaattccaaccgccttggagacgccccattgcatagtgtccagcgcacgcggattattacgaacaaaatgtagtcggcctcgatatcgctgccgatattgcgccgcattcaacggatcaaacgtcagtaagaaattaatatgttgatgttcaaaaaagtgcggtgcgacccaggccgtctgtctgagtgcccgataattactggttgtcaatgcatcacgatggcttaacgcaaaaccggcgttattataataagctagcgcattctgttggcgattggcaaaatgagtaatatcggtcaaaagctccttatccagttcgtgcgcactcaaaaactgcccttgatacgcgacgtaactcccattcgcactgacgattgaatcgatccccgtcgttgtcatcacatcttgaacttcgaatacattgcgacccgtggcaatgacgggtaggacgtggttagctcgtaattgctggattgcccgcacactgctggccgcaaccgtcttatcgtcctgcattaacgttccatccaaatcaaaaaacactactgcttggtacaaccaattaccccctaattaatcagtcactggccaataaccagcgccaccaatacactaattaccttcgtgatgacgtctatttaaagccatccgaaaaggtgctttagtgtttacctttattataagcacctcgtctgaacaacgcagacattctgcttataagcgcacaaaaatgcgtggccaatcaaggaaagccacgcactaatgtgcctacgtctcattaaggatcgatgagtacttcgtaatacataatcaatagcggggtgctattaaaaagtacaattatactatacggctgaaccgtactaacaatcatcaagttcctgtaaaatttaggtaaagttttcaataaggcgcaactgttcaccacccagcgtctgcgtcacaaggcagcgttgaatcgcttgtgctaattttatgggcacaccactcaactttaaatcgtgactcgtcatggttcgcggctcagtagtcacattgacaatcaccatcacggtctgatcagcctgccaataaaggtagccaatgccataatctgccaagtaaaacggcacaaagtgggctgtgtttaaccacgggtgccgttgacgccaattcgcccagtcagcgacaaactgaacttgcgcctgatctgcgtcctgccacggataaaacgcacggttatcagggtctttccccccccatcatcaacgcctcatcaccgtaatacaggcacggtacacctggaagcgtcaagagtagttggacggccaaacgtaggcgttggcgatcttcggctaacatagtcaggattctgggcgtatcatggctaccgatgttattgaagttaaagcgaaacgtcgtagcgggataattttccttgagggtcattagttcacgccaccattcggccggtgttagcgtgccgtttaaaacgtgaataatcaagcggcggagcggataattcatgacagcctgtaagccgccgccctctaagtagtgccggcgcatcccatacgctaatttatgagaggcatcctcccaaacttcaccgatcaaaaccttatccggataacggtcaagggtccgtcgaattccagcaatgaaatcgtctggcaactcatccgcgacatctaggcgccagccatccacaccgcgttgcgtccaatagtcaatgaccgaatcgggtttaccaaagataaaatcgcggtatgttggatcgtctttatcaactgtcggcagatcacggatgccccaccagctatcgtaatcgtggggataacgaatgaatgtgaaccacgggtagtacggactcgtggtcgactgagttgccccaaccgtcgggtaatggcccgcctgattgaaatacttagaatccacaccaacatggttaaaaacaccgtctaagatcagtcgcataccggcccggtgtacggccgcgaccaggttatcaaagtccgtcaaatcgccgacgaccggatcaatcttcagatagtcacccgtatcataccgatgattactgctggcctcaaagatcggcgtcagataaataattgtcacaccgagtcgctgtaaatatggaatcttagcactaataccgcgcaaattaccaccgtaaaaatcccagcgtaaaatcgcccggtgttcatcacgcacgtatagtgggcgatccgttagttgaccataaataaagctatttggcttgggcgcattaacgtggccatccgcgttgccattattgaagcggtcaacaaagatctgataagcaaccccttcacgataccattgtggcaatgtttctactgctttcaagattgtcaattgatacatttgaacatgctcgcgcaagacgtattgaacgcccgggccaccataaccaccatcaacgcaaccataataagcggtcatggtcgtcgtttcaatccgaaaatagtagaagtacaggccaacctgggtcggtataaacgtggccgtatacattgtgggactgattggatgtaacggtaaggcctgttcatcatcccactgaccatcatgagccacgcataaatcaatctgcttaaccggcgttactgtctgaacactgattgtgaattgaacgggtgtctggcgggtcacggcaccaaagggcgtcttatacgtgggtaaaaatgagttatacgttacctgcatccgtcacccttcctttcttaattcagtcgttcgtggggcacttgccaaatatcgtcagcataccgcgccactgctaagtccgcggcaaagtgtcccgaagcggcaatgttggctaacgagcgttgttgccaagtgggttgattttgaaaatcacgactgatctgctgttgttgggtgacataagcccggtaatcggctaagacaaagaattcatcattataccgcagtaatgaatcatagatttcccgaccaaccgttggaattcccggaatcgtgccatcaatcaaactatctaagagccgttttaattcaggatcagcatcgtaaaagtcagcggcgtgatagttgccgcgatggtaatagtcgtacacttcattgaccttaagcccaaacggatattcattttcagcacccgccgcttgcataatgtcgatattcgcgccgtcatacgttgccaatgataatgcaccgttggccatcagtttcatgttactagtccccgacgcttctttggaggccgttgaaatctgctcgctaacgtcggcggcgggaatgatcagttcggcaatggagaccccgtagttcggaataaagacgatctttaaccgatcaccaatcgccgggtcctgattcaccatgtcagcgacgacattaatgagtttgataatcgccttggcatagtgataactaggagccgccttggcaccgaaaatgtgtactcgcggcacgactggctgttgcggatgatccttaatggcaaaatactcgcgcaagatttcaaagacgtgtaggagttgccgcttataagcatgcaaccgtttgatttgaacatcgtaaatcgcgtcggtgcgaatcttgatccccatagtacgctgaacgtacgcggctaaagcttgcttgttagtcagtttaacttgacctaactggtacaaaaagtgatcatcttgttgatacggcagtagcgtctgtaataaatctggttgccgccgccagtccgaaccaatcgtctgatcaatcaattgcgctagtggttggttcgccaattgaacccaccgccgggttgcaatgccattcgtcttattattaaaccgctccggataaacttgatacaggccccgtaacacatccgttttcagtaattccgtatgcagtggcgcgacaccgttcacactgtgactcccaatcacagctaggtaggccatccgtacttgtccgttgcctaaaggcgccgtctgatcaacgagcgctttgccaaaaatcggcgtttgttgttcccggtagcgccggtcgatttccgcaataatctgataaatccggggtagcaggtttttaaacatatcgattggccaagtctcgagggcctcttgtaaaatcgtatggttcgtgtaactcatgacttgcgtcgttaacgtccacgcgacttcccatgaacagtgatgttcatccattaatagccgcatcatctcagggatcaccagcgtcgggtgcgtatcgttaatgtgaatcgcgacctttttgcctaacaatttgatgccatggtgcgtcgcacaaaaatcacgcacgatactttgaacacccgcagaagagaaaaagtattcttggcgtaaacgcagttgttgcccggccgagttagaatcgtcaggatacaagaccttggtaatctcactgattcgatcacgctgatcctgcgaagaataggtcgcactgggtggtaactccgcggaccacaaacgcaaggtgttcgtaatatcgttgtgatacccgacgataccaacgtcgtaaggaaccgctagcacgtcttccgtattttcagattgcggttgtaaactaccatccgcttgcggttgtaaccacacattgccgccgaactggacaatgcagctcttgttatcgcgccgggtctcccacacgttgccatgatggagccaatcatcgggtaattctacttgatagccatccatgaaaacttgtttgaacaagccgtaacgatagcggatgccgttaccgttgccggcaattttcaaactagccatcgcgtccatataacaggctgccaaccgacctaatcctccgttaccaagcgccggatcaggttcagcctgactgattgtctcaaagtctaagcctaattccgttagccctttttttaccgtcgtcaataagttgagattcaacaaattagaagcgagtaagcgtcccggcaagaactcgatggaaaaataatagacttgtttctgatgatgatcgcggtaaaatttagctgttcgtgtccaactctgactgttatagcgccgaactagctgtcccagtgcaataaattgcccaatcgtcgaggtgtcactcagcgatgttgaatacaaggtctcaatttcacttagaaaatcctttttaaattgcgcacacgttaatttcaaattcacacccccatcaaacctaacgcattagcttctgataagtcgcacggtactgctgtgcagaatgttcccagccaaaatcacaagtcattgcttggtgctgcagctgccgccaaaccagtggatgctgccgatataaggtcacggctagaaccataattttacgtagaaccgctggctggtagtcgtcaaagctaaagccggttccctgatcggtatagcgattgtacggaatgaccgtgtcccgcaacccaccgaccgcgtgcacgatcggtaacgtcccgtaatgcatcgccatcatctgcgacaagccacacggttcaaaggcagaaggcataagaaagatatcactggccgcatagatttgctgagctagctgcgtatcaaattgaatcgcggcgaccaccttttgcggatacgccgactgataggtgcgtaacgcgcgttccaatgctgggtcacccgttcccaaaacaatgagttgcacatcttgttgctgcaagaatggattcaatgcatccagcaagaggtcgatacccttttgcttcgttaaccgagaaacgactgccaataccggcacgtttttgacaggcaaccctaatcggcgctgtaaagcacgtttattctgacgcttaggtttcaaattcttagccgaataattcgccgttagtgccaggtcggttgcgggatcgtataattgcatatcaatgccattaagaatcccactcagtttgtaccgattggcccgcagtaccccgtcgagacgttccccaaaagctggtgtttgaatctcttgtgcgtaggtcggtgacaccgtattaacggcatctgcaaagttaataccgcccttcagccagttcacttgatcgtaaaacgccacgccggcttcggtgtaggtctcagttccgattcgaaagagactatccaaaataatcggatcgtagacaccttgaaactgtaagttatgaatcgtcagcaccgttttaatatcacgatacgcttcgatccaatagtacttttcagctagcaagacaggaataaacgctgtatgccaatcattgagttgtaaaatatcagggatataatcgatccgctccatcatttcacaaacggccatttgaaagaaggcaaagcgtgcaccatcatcccaataaccatataatccttcacggccaaaataatctaaattatcaattagataatactgaacgtgcgcgactgtcagagttttaataccgcaatacatcgcatgttcacccacttgaacagtaaaatgcgtcactggcactaactgctgctgatattcggtcagcatctggtgagggtaatacggaatcactacacgcgtctcaattccttccgcttgcaaggcgcgcggtaacgccatactaacatcgcctaagccaccagtcttataaaaaggggccgcttctgccgccgcgaataataccctagtcatgcacagccacctccgcttgttgaaagacgtgctgccctttgctgatgactaacggtgtcgttgaagttcctttaagcactaggttgggcccgattacggcgtctttatcgataatgacgttttctaacttacaaccggcaccgatccgggccccctgcataatgatggcatttttaacttggctatcacgattaatcagtacatcccgaaagatgacggagtggtcaagttgcccttcaatatagcccccagtaccacataaactatcacgacactgtgaaccagtcgcaaagaacgtcgggatttcatttttgaccttggtgtaaatacggcgcgaactgtagaataacgctcggaaattagcttcatccaaaacggccatattggccgcaaagtagctgttgatatcatgaatattcgcctgaaagcccgtatattcaaaagcattagcgttatgttggatgactgcttgccgcatcaattcctctaggctgatcatgtcaccccgttgattggccgactgcaataattcgattaaatcgaccgtactcatcaagtaaatagccatgctcttggcaacttgtttcgtcttcgggctaatcttggccttgctcatcggaacgaccgccgttgcttctcccttagcagtcaattgtaagattgtattttcgggaatcaaactagctggatcaacgcgcttataaaccgccgtcacgggactgttacgttcctcgtgataccgtagtagcgcctttaaatcaatattaccaacattgcgagtactcatcactaccgagtactcactctggctgcatttcagaaactgaatcgaattatcatagtaatggtgcagtaatgcggccttcttttctggcgccactaatttcaagtcattgtatggggacaagaataggccgccgcgaattgtgttcaggctccagtcacgcccgctacgcaaatgatcagccacggaacgccctgaccgcgggaccgtcaccatcacattttgaatccccgcattgatgacactcgataattgaaaatcaaccaaccggtaacgaccaccaaagggtaacattccaactggccgaactgcggtcaatggttgtaacgcgtcacttggttccagtaaattaataatggcactcacttgttcacgtctcatggttgttccacccccatcgtttcgtgatacccaacaactgcaatcttatcagtcgtaccaataatctgggcatcatcaccaatcactgcatcttcgccaatcaatgcgtggtcaatcaccacattttttccaatcgttgcaccgggcataatcatactgtcgaccacgcgactacccatcccaactgacacgcgttgcgataagattgaatgatcaatttcgcccgcaacgtaacaactatcaacgaccatagcatttttgacttggctcgtttccgtcaaaaacatcggtggtagcacctctgctttagagtaaatccgccagtaacgatcgccgatatttaaccgattatggggcgataggaattccatattggcttgccacaggctcttaatcgttccaacatctcgccagtaacccttaaaagcataagcgtaaacggattcattattggctaggtatgatggaatgacatttttaccaaagtcttcaagtgacttatcggtagcataactcttaactaagtaatcccgcaaagtcggccagttgaagatataaatgcccatcgaggctttatcactcttaggatgttccggtttttcctcaaactcaatgattcgatccgtcgcatccgtattcatcatgccaaagcgtttggcttcttcgttagtcacgtggatcaccccaacggtcaacgaagccttcttctcctgatgatatttcagcatagcgtcataatccatcttataaatatgatcgccagataagacgagcaggtacttggggtcttgttgatcaatatattcaatattttgataaatggcgtgcgccgtcccttgaaagaacttctcaccttcactagacgagtatggttgtaaaaccgtcaccccaccatttaagctatcaaagccccagctcgcaccgctaccaatatgtgcattcagttctaggggttgatattgcgtgataaccccaacggtattcacacccgagttagcacagttgctgagtgtaaaatcaataattcggtaacgaccgccgaatggcacggcgggcttagccgtatccttcgtcaacttaccaagccgggtgccctgaccgcccgctaaaataatccctaacatttcatcttgcatgcttaactccccctatcactttaactggtcgaatcaacaatgcactcatcgccggcaaggtcacggtaaaactagctggttgcccccgatacggcttatcgaccgccgtaaacgttgtttctagctttgtccacgtgccgccaaaagcctgcgcttcagtgttgagtaacaactcataacggccacgatacggtacgccgatccggtaatcttgacgttcaacaggaacaaaattgaaagcagcgaccacaaaactgtatttccgtttggcctgccggataaaccccatggtcgaactgtcaggatcatcggtatgtgtataaataatccccgcaggatcatggtcctgttcccacaacggccgattgtgccgatagaccgcgttcagttgcgttgtgaactgttgcatccgatggttgagatcatcctttaagtcgacccattccaacgcactccagtcccgccactctaggaactgcccccactctgagcccataaaattcagttgttttcctgggaaggcagccatataagttagcatcgtccgcaaatttgcaaactgattatagcggtcccccggcattttatgcattaatgatttcttgccgtgcacgacttcatcatgtgaaaacggtagaataaaccgttcatcgaacatgtacacgaatgcaaatgtcagtagattaaagtggtcgtgccgatataacggatccatcatgaagaaatccagggtatcgtgcatccaccccatgttccacttatagttaaatcccaatccgccattggccaccgaacccgtaacctgcggataggcggacgactcttccgcaatcatcaagatatcgggatggtgggttaagaccgtggtgttcaacttttgtaaaaaggcgatgccttctaaattacgattatccccatactgattaacctgcccttcgcgcccttcatcatagtcgcaatacaacatgttagagacagcatccactcgcaagccatctagatgacactggtcgagccaatattcggcgcttgaaatcagaaaactctgaacctgtgttttaccgagatcaaaattccatgccccccaacgacggttattcgcgcgctcaggatcagcgtattcaaatgtcggcgtaccatcatactggtacaacgcatcataattgcgaataaagtgacccggtacccaatcaacgaataccccgatattcgcttggtgacactggtcaacaaagctgagaaaactgtcacgcttgccaaaacgactggttggcgcaaaataccctaattgctgataaccccaagacgcatctaacaaatgttccatcacgggcattaattcaatgtgggtatagccccgttgttttacatagggaatcagttcagcggctaattccgcataagtgtagtagctaccatcaagatgacggcgccacgaacctaagtgcacctcataaatgttaattggccgattggcagcgcgcgacttcttccggcgagctagccacaaactatcgtgccaacgcatcgtcatcggctcaacaactacggccgcatcccccggttttcgttcgaactgttgtgcaaacgggtcaatctttagttgcacttggccagttggtgttgtgatctgaaacttgtataactgacccgcatgaacattcggaacttgtccttgccaaatcccagtcgcccctaataactttagtgcgcttggttgccagtcattaaaatcgccaacaaccccgaccgccttagcatgcggcgcccagacgcgaaataccgcccgaccagatgcggccaaatgacagcctaagtaatcctgactattaaatcctgcgccggtattaaataagtaacttgcatcattcatttccgtagtttgtttaaccaaagcatcacaccccctatgtgattaactgagcagtttataaaattaatcttattataagaaggtgacagggtgtttgcctatccttgataaggtcgccttacttagtggtcaaacagggcacaaacccctaaaagataacgattattatgactggtcacccagaacactgcaaactgattcaggacaactattcacagttaagcccgtggttatccattttattgcgccgtttgccaaaacatcaaaaaaagcccgaaaaaacgcgttttttcgggctagttgatttattcaattacatttctatcaaattaataatatttatctgactgattacttccagtaggcatagcgataaagggcgtctcgcaacaatgtgaagtgaaccccaccaaccttgttactgatcaagtgagcagcagcagtttgataaatcggtgtgaccccctgttgctgagcgactagcttagccgcttgctgcatcgtctgatatcgggccttagttgactgcttatcggccgtaatcgttgagattaattgctcatatttcgcattgttaaacttcccaaagttgacagaattagttatcgaagccttattcaagaaatcaactggatcttggaaatcactcgaccacgacaacgtggcaaagtcaaaatcacccttgcttaaagttgaaatctcatttgtcagtggtactgacttgacattgaccgtgacaccactaagatttttctcaattgcagcttgaatatattctgccaccgacttattaatatcattatcgttcgtcaataattgcagtgttaacttttgctttcctaagctcgcctgagccttctgccaatactgtttagcctttgctggactgtatggatacaaatttccggtatccgtattaaaatctttccctgttgtcgggtttttggtattgccagcaggaactaatgacgtcgccgctactgagccgtctttgagaacgttcttaaccaatgactggcgattcaaagcgtaactcacagcacgccgcaagtcagtattctgcaatgctgagcgcttctggttccacaacatgaagtagagttgatttaacttcgtaaccttcatctgactttttagtgacccttgctcagctgccgatacttgggtgcccgtaatctgggtgacttggacctcattgctttggaagaggttctcggccgtactgttatttttgaccgtctgcaccttaatattcttgattcggacctgtttacggtcataataatacgggttcttcacatatttccacgtgtcattcgtcccattccaactcttcaagacatagggaccattagagagcgttcgctgtgccgatgtcccatacttattcccgtatttctcagtaaattgtttgtttaacggatagatctctgtggctagccgataattaaaatacggcacgcgctgttgcaatgtaatttgtaacttatacttacccaacgctttaacgcctaaggtcttcaccgccttcttaccagccgtgattgccgttgcattcttgatttcagcaacgtgtccgacttcctgtgacttggtattcggatcgacctggcgttgcacggaataaacaaagtcagcggccgtgaccttttttccattcgaccacttggcattgtgtcgcaaattaaaggtataagtcttcccattattagtcggtttgacgactttcttggcaattgccggcacgactttccccttttgattagttgtgtacaagccttccataaactgagcaatagcggcctgactagcgatatcgtcggccttattaggatcagcggtcgcaatcgactgggtcgccgttacgttcaacgtcttctgctgactactctgctggctaccgcagccagttaacactaatcctagggctacaatagcaatactgctgatccatattctttttttcatgaatgatgactcctaacttaacgatgatgtcggttactggcaacgatacttcgattggcgccgacaacaacacatcaacggtaagcctccgttatccgtggtaaaccggtaattactggttttcacgactacaataacgttttgcaatcctgcgttcatcatcatgattcctccccttagattaaaaactaattaagataagattagcttttaagtttacatctgtcaactaaaagtttcgctcagcattctaagtcaccatggtattatgccttcactattcaggccgaaactagcttgcgcttttgaaccagacgtatggtacgcgagcttaaaactagaccggctatgttgggttatcaaatcaagaagtcaaaaatcggataaacacttgtctccccaatcggcaataaaaaaatcgctattagccgatatactgactaataacgatacttgcccatcaatggcgaatctgaccattgccatcaatgacatatttataagatgttaattccgctaatcccatcggaccgcgagcatgtaacttctgcgttgaaatcccgatttcagcgccaaacccaaattcaaagccatccgtaaaccgggtggaagcattgatataaacacacgctgcgttgacccgttgctggaagagcttcccagcttgataattatccgtcacaatagcttcggaatgttgggtattgtaacgattgatgtgcgtaatggccgctgcttctgaatcaacaactttcactgcaataattaaatcattatattccgttccccagtccgcatccgttgctggaaccacatcaggaacaatggcttgagttgcggcatccccgcgtacttctacgccttgttcacgaagtgcctgaatcatgctaggtaaataatcggccgcaacctcacgatgaattagaagcttttcagtggcgttgcaaaccgatggtcgctgaaccttcccattgatcacgatatcggttgccatttgcaattgcgcgtctttgtccacgtatacgtgacaattaccggctcccgtttcaataacgggtaccgttgctttagccaacaccgtttgaatcaaacgggcgctcccgcgtggaattaagacgtccacgtaatcagtgagctgcatgaacttagccgcagtcgcatgcgacgtatccgtaatcagttgaatcgcattctcatcgaccgcttcggcccgtaatgcaccacgtaagacttggacaagtacttgattagagtgaagggcttccttaccaccgcgtaagattacagcgtttccggttttaaaacatagtgctgatgcatccaccgtcacattggggcgcgcttcaaaaatcatgccgataacacctaatggtacccgttccttggcaatcatcaacccggcctcgttgcgccacgcgcggtccacatttccaattggatctggcaaactcacgacctgtttgagtccggtcgccatatcctggatgcggtctgctgttagccggagccggtcaacaaacttaactggtacttgcgggttctctaaatcctgcgcattagctgccaatatctcatcttgatggctcgttaacgccgttgccattgcggtcaacacttgatttttttgcgccgttgaaagtaatcccagcgtatagctagcttgttgagcctgctgacccaactgttctaaatctaccattttgataacctccccaacttaaccgaatagcgttccgactggttcgcctgctaaaatttgaaaaataattgtgggatccgcaccattggctaaaatcatttgaccattcgcatcgatcatccgttctgccgcttttagcttagtgaccatcccaccagtaccaaaccgactgccactaccgccagctagcttataagtatgttgatcaaccttctcaatgtgccctaataactgggctcgggcatccgcattgggattaccatcataaaagccatcgatgtcggatagcatgattaacaaatccgccccgatattcgtggccacgattgcggatagttgatcgttatcaccgaactttgtttcatgatccaattcatcgaccgcgaccgtatcattttcattaacaattgggaccacgttttgttttaatagcgcctcaaatgtattcaacacattatggtgactcttaggataaacaaagatatcacgtgttaataacaactggccaattttttgttcataaatggcgaagcgttctttgtaaatcgaaatcaattcagtttgcccaatcgccgcaatcgcctgttgttcaggaattgcttttggacgttgcttgagtcccatatagttcaagccaacaccaatagcccctgacgaaaccaagacaacttcacgcccacggtgtcgcattgcgctaatgacaaaggctaattgatcgattgcccgtaagttgatcgatccatctggataaactagcgtgcttgtcccgactttaatcacgactcgtttagcctttagttttcgtatcactttcactactgccaccaacttctctaattattttgtttcacgtgaaacatcggtctgaacgtccgtcttcatataattaacggccttgcgtaaattaaagtgaacgacaccgatattaactgccaacacgatcaataaaaccacaaatgccaacaaaaacagcaccttataagaccaattatcgataatcacaccaccaaataacggccctagcgagcgccctaacgcacaaaaggcttgtactagtccttggtaacgccccttagcactaactggtgataactgactcactagtgttggcatggctggtgaccaagttgcttcaccaatcgtcaataaaatcatggcaaagataaagtgtgggtaatcatgcgcaatcacaagtgatagaaatgataagcccacgaatagcatgccgaagaaaaattgattatataaatttttaatccgattccccagcaaacttaaaatactctgaataaggaccagtaagcccgcgttgattgtccatagaaaactgtaattccgcagcggcatccccaaattcgtcatgtagacggataaattgctgacccactgttcgtatagcaaccagataataaataaactaataaagaaggtccagacaatgtgaaaattggcccgtggcaagtgcacatcttgtccttggcgcggatcaaccccggtcacgttcgacgaatccacattgtattcaaataatgcaataatcaagaaaatcacgaagaggctcgtggtcatcgagaatagcaaggccatccccatgctatacacgataccaaccagcatcgtgccgaagacaactccgagattggcagcgagatacatcaacgtaaacgttcgccgcactttatcgcgggggacactggcagccaaagcattaaacatcgtatttagccagccactagcaaacccggtcacgactaacaacatcggataccacggccatccatgaaaaaagatcagagcaaagttcgcgaggccattcaacgtgattcccatcagtaacaggtgataaggattacctcgatcaaatatacgcccaccaatcgtacttgccaaaacgttggcaactgaattgagcatcaggacaattccagtctccgtcaacgacttacctaacacattgtgcatgtagatcgtcgttaacggccaaatgaaactcataccaatgttattcataaactgcccggcaattagccacggcgttttaatgagttgcttttgtgccacgccatcaccaccattattaaatctgtctacttttcatcatagcaaagtttatttaaaataacagggacatttatctcactaactcattattatcacggccaaattggtgcatcagcccaaccaattggcggaaaacaagtagcctcggcacgtgataaacaaaaaattcctcttaattagtttaagaggaatttgataacaaatttattgatcgactgcaattaagcttggggatcctgcgcataagagactgaggagaacttattaaatggtttcacaaataatagtttgaccgttccccgcgccccagcacggttcttttcgataatcacttcaacttcaccaacatcctcagaagcatcttcgtcccgcggatcgccgccattaaagtcaccaccgccaccaaaattaccgccatcatcatcgtcgccgccttcgcgatcataataatcttcccggtataggaaggcaacgatgtcagcatcttgttcaattgaacccgattcacgaatatcggaaagcactggccgcttatcttgacgctgttcaacaccacgagatagctgtgataaggcaatgactggaacacctagttccttagccagtttcttcatttgccgcgaaatttcggaaacttcctgttgccgactttctgtgttactaccttcgatcagttgcaaataatcgaccacaatcaagccgaggttaccttgctctttcgctaagcggcgacttttggcccggatttctgacatcttgattccgggggtatcgtcaataaaaatactagctttagacaaactccccatggcaaccaccaagtgttcccactcttcttcgttcagttgccccgtccgtaaatgcccagcgtcaatactaccttctgcacacagcatccggttgactaaggattcggcacccatttccaaactgaaaatggccactgtcgtatccgttttagtcgccacattttgggcaatattcaggacaaaggctgtcttaccaacggctggccgggcagccaaaataatcagattatccggttgtaagccggcggtcattttatccagctccgcaaaaccagtcggtaaaccggtaatgtcatcatcattttgatacaagcggtcaatttcttcaatcgacgcgttcaacacatctgaaatcgacttaaacccactctgattacgctgttcagacacgttcataatgtcgcgttccgcgtcatctaataacgtggtcacgtcatcattttccgtataggccttttgcgtaatctccgtggccgtcttgatcaaccgccgcaccgtcgccttttgcgccacaatcttagcatagtagccagcgttagccgcagtcggtacggacccagctaattcagcaatgtagctcatcccaccaacatcatccaattgattttgggccgttaataaatcactaacggtcaccgcatcaatagcctcgtcacggtcatttaaagtcaccatgctggcaaaaatgatctgatgtgcgcgccgatagaaatcttgcgcttcgacaaactccatcgcttccacgagggcgtcactgtttaagaaaatagcccccaagactgccttttcagcttcaatattttgtggtggggtttgatccagcacatcgttgttcatttgtgatccgtccttttacttttcgacaacgtgcacgcgaattttcgccgttacttctggatgtaacttaacgggcacgtttgtgtaacctaatacccgaattggttctggtaattcgatcttgcgtttatcaagcttaacttggtattggtcagctaacgccgttgcaatttgtttgctaggaattgacccaaacaaccgaccatcagtaccagctttggccttcaattcaacaaccgtttcatcagcttccaaaactgtcttgacttgcttagcttcggctaattcctcagcggcacgtgctgcttcagacttctgttcagccttcaacgtattgattgccgctttagtggcttccttggccaatccctttttaattaaaaagttctgcgcgtaaccatccgggacattcttgatttggccccgcttgcccttaccacggacatcattcaaaaaaataacttgcatttagactcactcctaattagattctgtggtcggctcatcagttgccgttaacaaatcaatcaacgattgtttgacggcttcaactgactgcccttcaatctgggttgcagcattcgataaatgaccgccaccacccaatttttccatataaacttgtacgttgatctcgccaagtgatcgtgccgaaattccgacccgtccatcttcacgacgtgtaatcacgaatgatgcgtcgacaccagacatagataatagtgaatcagcagcttgagccgccgttactgggtcatagacctgatcatcttcaccaacacataatgccatatcctggttaacaaattcaacggtttcaatcagatgattgcgttgtagataactatcaacgttctccttcataaattgttgaacgagtaacgagtccgcaccggctgatcgtagataactagcagcatcaaacgtccgcgatcctgatcgtaatgaaaacgacttcgtatcgataacgattccggtcaacattgcggttgcctcaatcttattgattggttcggcatcgtgcgattgatattcaaacatctcggtaatcagctcacaagtcgacgaagcatacggttcaatataaaccaaaactgggttttctggaaattcttcgccccgtcgatggtgatcaataatcataacgcgattttcgagccgctcataaagggcctgtgacattgaaatacttggcttagaatggtcagccataatcaataaactttggtcagtggccttctcaagtgcttcttccggcgagataatcgctgactcgatgttctcatcagacttcaactggtccagtaaacgctgaatgtctgaatgcacattttgctcatccaagacgatccaacactgtttaccattcatttcagcaattcggcgaatcccgagacaggccccaacggcatccatatctggttggcggtgcccctgaacaaagatctggtcagattgattcattaactcttgtaacgtctgactgatcatccgggcccgtacccgcgtccgtttttccatcgggttggttttaccaccgtagaaacgagcaggttcgtcctcagacttcaccacaacttggtcaccaccccgccccaaggcaaggtccatgttactctgcgctaaatcggccaaattgttcatgttccgttcaccataagcaatcccaatactcaatgttagtgggaaattttgcttagaagtcgactcccgaattcgatctaaaatgcgaaacttattctcttcaacacgtcgtaaactactagcatagcccaacaagaagaagtgatcatcatccaagcgcttcaggtacatcccaaacatctgggtccacttagacaattcattggtcacgtaattgttcaggttggaaatatccgtatcagtcatcgactgggtgatttcatcgtaattatccaaaaagatttgtccaatcacgagtttttcatcttcgaattgatccgtcagctcagcatacttggtcacatccatcatatagaccgtattagtgctctgctggacacgtacatcaaactggtagtcttgccaacgaatcgtcgcgggctcgtccagatgagcgttcagcgtcgctgccagtgttggctcaatatcttccaagcggtatcctaagacgtccttatcaccgaaatagcgctgaagataaggattgatccattcgatggtctggtcggaattaaaaatcattactccgataggcatctgaatcagtgcctcttgttcgccgcgcttaatacgatacgacaagtctgagatatattcatttgcactcgaactgagctcaatcaacgtattataagatatcaccacagccatcacaatcaagatgaggacaacggtcccaaaaatccagttcattaaataaccagtgacgagcataattaacgacaagctaaaaataaccaacgctaagagtcgtaactgctgattttgtaggaaaaatggaattttttcacgcgaaaagatctttttcatattaaaaatccctcaagccttctcagtaatgactatattttatcacaaaccaccgtccgcttcagcgtttcgtgtcaatcaccgtaaacgcttcattgaacggccaccaccctatctagtcaagttaagggtaaataaaaaccacagagccgaagtctgtggtttttgaatgactaaaaattagtcttcagatacaaaggctaataagcccatgatccgtgcacgcttgatggcgatagttaaagaacgttggttcttagcactagtccccgttacacgacgtggcaaaatcttcccacgttctgaaataaagcgacgtaataagtcagtatctttataatcgatgtattcgatatggtttgcggcgatgaagtcgactttacgacgacgacggccacctcttctttgttgtgccattgatatttccctcctcgttatctgtctaagcaattagactagaatggtaaatcatcatccgagatatcaatttgatcgccattattagcgaatgggtcagcctgattattgttgttagcactgcttgatggtgccgcactgctagcattaccagtattaccattaccaaatgggttattgttattcgctgatgattgttgaggagccgcattttggccttgattactatacccattattattgttgttgtaattcgaattaccattgttgtaattgttattaccactaccaccattggcagactgatgacgttcagactctgcccgtgattctaataatgagaagttttcaacgacaacttctgtaacgtaaacacgtaccccttgttggttttcgtagttccgggtttgaatccggccatcgataccaacaagtgaacctttatgagtaaagttcgcaaaattttcagcagctttacgccaaatgacgcaactaatgaaatctgcttcacgttccccattttgattcgtgaattgacggtttacggcaatagtgaacgtcgcgacggcggcaccaccattcgtgtaacgtaattccggatctcttgtcagtcggccaacaagaattgtacggttaatcatgcagaagcgctcctctcttaaaattaattttgtctattagtcttcgcgtttaacgatcatgtgacgtaaaatgtcatcattgatctttgaaagacggtcgaattcgtttaaagcagcatcgtcagttgctgttaagttaacgatatggtaagtaccttcgttaaagccaccgatttcgtatgcgaaacgacgctttgaccagtcttttgaatcaattacttgcgcaccgttatcagttaagattttgtcgaaacgatcaactaaagctgtcttggcagcatcgtcgatgtcgggacgtacgatgtaagtaatttcatatttctttgattcactcatgaaatttgcacctccttatggacttcaggcccttctttttgaagagcaaggaaagtaatctagctaatgctagatactcacgaatttaaagtatagcatctaaatcagtttgttgcaagggttgaagcggccgactgttacaaaaagatcctgaatccgttacaccaatcaattacgtcaattgagcgatatttcattttatttcccgggaaatatttcttttttctgaaattctccccttcgcttacattttcccacacccacacagcattaatttaaaccaagtcgacgtcagaataacacgcactgctgtaatcctctcaatcgcacaagccagttttgaccgcgtaaatctaaaattgcttacttcatgttgtcctctcccaatttatcggcatttctgccaatcactggaagatggcaagactaagtgatgagcctccagcagtcaaattattcttcgcaggaagattgtttctaccggttcaaaacaagactttggaggccagaataggaccgatgaccggtaaatcacacacgacccgttgccaaaataattcttgactcgcataaaaaaacaagcgtggtcgacaagattgtcgaccacgcttgttttatcaatttattcgtttgaatcagttgttggttctgtcgtagtggcatcggcgttgacggtttgatcgtcaactggtgcctcagtcgttgcatccgttgcgacagtctcatcaacttctggctctggatcaaccttggccatcgttgcgacttgaccatcatcgcctaaccgcatgagacgaacacctaaggttgcccgaccagtctgagaaacggttgcgatattgaagcgaatcatgactccttggttcgtcattaccatgatatcttcttgaccatcaaccgtcgtcaaaccagctaaatgaccattcttctcagtcacgttagcggtcttgattcctttgccaccacgccccttaattgggtaatcggcagctggcgtttgtttcccataacccttttccgtgatgatgaagacgttgctgtcgggcttcaaaacgtcaaagccaatcacaaagtcatcatcgcgtaagcgaatcccgcgaaccccagaagccgtccggcccatggaccgcactgtggtttcgtcgaaactgacggcataaccgtcgtgcgtcccgatgattacattttggtgaccatccgtgattgtaaccccgattaattcatcatcatccttaagcgtaatggccttcaaaccattgctacggatattggcaaattcttgaactggtgtccgtttgacaacccctttaacggttgtaaagaacaggtagttatcagaagcgctcgcatcgcccgtgacattaacgaccgcctgaattttttcaccagaattgactcccagtaaattgatgaccgggattcctttggccgtacgaccgtattcaggaatctcgtaagccttcatccggtaaactttacccgcattagtgaaaaagagtaggacatcatgggtcgacgtcgtcagtagatgttcaataaagtcatcatcatggacgtccatcccttgaatcccacgaccaccacggtgttgcgacttaaattcagtcgttggtaaccgtttgatgtagccattgtgagttaaggtaacagccacttcttcttcttcgatcaagtcttcatcttcaatactgaggacttcaccgaccatcaattcggtccgacgcttatcaccaaacttacgttgaatttccattaattcttcgtaaataatttggttgatacgatccttgctagctaagatttctttgtagtcagcaatggctttcaataagtcctggtattcactctcgatcttttcacgttccaaaccagttaaccggactaaccgcatatcaagaatggcttgtgcctgcttatcagacaagccgtaattatccatcaattggttcttcgcaatttcactcgtttgtgattgacgaataatcgcaatgatttcatcaatgtgatcaagggcaatccgtaagccttcaagaatatgggcccgtgcttgggctttcttcaagtcaaactcagtccgacgccgaatcacgtcttcttggtgttccaggtaatagattaagatttgctttaagcttaagacttttggagcacccttaacgatggctaacatgttaaagccaaaattagtctgcatcaatgtcatcttgtaaaggttattcaagataaccgaggcgctggcatcccgccgaacatcaatgacgatccgcatcccttcacggtcactttcatcattgatatcagtgataccttcaatttccttgtctcgagctaaaccagcaatccgttcgatcaatttagctttattgaccatatatggtaattcagtcacgataattcgttgcttaccattcttttggtcttgaatatcgaccttcgcacgaacaataatgttcccacgaccagtctggtaagccttacgaataccggactttcccattacgatcccgccagttggaaaatctggtccaggtaagacttccatcaagtcagcaactgttgcatcaggattatccatcaacaggtggattgctgaaatgacttccgctaagttatgtggcggaatgtttgttgtcatcccaacagcaatcccagtggcaccgttaacgagtaagttcgggaaacgtgctggtaagactgctggttcccgttctgtatcatcatagtttggttgccaatcaacggtatccttgttaatatcgcggagcatttcaaccgcaatcttactcatccgggcttcggtataccgcatcgcggcagccccgtcaccatcgacagagccgaagttcccgtgaccatccactaacatgtagcgatagctaaagtcttgggccatccgcaccattgactcataaattgcggagtcaccatggggatgatacttccccataacatccccaacaatccgggccgacttcttatacggcttatccggcgtcacacctaattcactcataccgtaaagaatccgccggtgcactggctttaacccatcacgtacgtccggcagtgcccgtgccacgataacactcatggcatagcttaagaatgacgttcgcatggtcttcgaaaggttcacatccgaaatacgattgttcgataaatctgaatcagccaaaatattcgtcctccttcatccgttttgccgctattaaagcttgattaagctttacatgtctcaagtaaaagtcgccattaagacaaccgtcgtgccattacgaccctaagtctgattaacagcttgcgcctcagttcttaggtcaaaatgactaaactgacacactaaacatccagatcctggacgaacttggcattatcttcaataaattctcgccgtggtttgacttggtcccccatcaacatcgagaagaccccatcggcatccgcagcgtcttcatcacgaacccgtaataggcgccgcttgtctggatccatggtcgtttcccataattgttccgcgtccatttcaccaagccccttgtaccgttgaacaactggtttcggtgatggtgccaattgccccatgacctcactcaattcttcatctgaatcaatatacttcacaaatttaccttgccggacttggtacaacggtggttgagcgatgtacacaaagccagcgtcaactaatggccgcatgtaccggtaaaacaacgtcaataacaaggtccgaatatgtgccccatcgacatcggcatcagtcatgataattaatttgtgataattggctttgctcaagtcgaagtcaccaccgaagccagttcccattgccgtaaacaatgaccggatttcttcattggctaaaatcttatcaatgctggccttttcaacgttcaaaattttaccccgaatcggtaaaatcgcttgcgtcaaccgggaacgtccctgcttagccgacccaccggcagaatccccttcgacaatgaacaactcactaatttcagggtctttactactgttgtccgccaacttacctggtaaattactaatttccaagccactcttttttcgcgtaacttcccgcgcacgcttagcagcgacccgggccttggatgcaagtaaccctttgtcgaccactttacgggcaacacttgggttttccatcaagtacttgctaaagtgttctgagaataaccggtcaactgctgcccgagcatcggaattaccaagtttcgtcttcgtttgaccttcaaattgaggatccggatgcttgacgctgacaacagccgtcatcccttcacgaacatcttcgccagataggttcgcatcgctttccttcaacaagttattcttacgagcatagtcgttgatgacccgcgtcaaagcacgtttgaaaccttcttcatgcgtcccaccttcgtacgtatgaatattgttggtgaaggtcatcaaattactgtggtagtcgtcagtatattgcaacgcaacttctaccgtaatcccattctgttccccttccacataaatcggttctggaaatagaacggtcttattcttatctagatattcaacatagtgacgaatcccaccttcgtagagaaagtcatcttcagtgggttcatcagggcgattatcccgaatcgtgatccgtaatcccttatttaagaaagcgagttcgcgaatccgagtcgtcaaaatattaatgtcataggtggtcgtttcccggaaaatatcaggatccggaacaaaatgaaccgccgtaccatgagcatcatcaggcgcatcaccaatgatcttcatcggtgttttaacctttccacgttcaaagtccatgtaataaacatgaccattccgagttactttgacgtccagggtcgatgataaggcgttaacaacggaagccccgaccccgtgaagaccaccagagactttataaccgccaccaccgaatttaccaccggcatgtaaaatcgtataaaccgtttcaagcgctggtttacccgttttttcttgaatatcaacaggaatcccacgaccgttatcagtaaccgtaatactattatccttttcaacggtcacgtggatcacgtttgcaaaccctgctagggcttcatcaattccgttatcaacaatttcccaaactaagtggtggagtccttggctactcgtcgtaccgatatacattccgggacgtttccggacagcttctaaaccttccaaaacttgaatttgactagcatcatattcgcgagcctgttcaagtttggtttctttttcgttttcggtcaatgcggttcctcctcatgtaaagtgccatggctaacttcaaatacttttggcgcattaattaatttgcgggccaccccgtcaagacttggcgtggttaaaaaggtctgcactttatcttggatcgctgtcagcagatgagtctgccgtgcagcgtctaattctgataagacatcgtctaataataagaccgggtactcgcccgtctcagctttcatcagatcaatttcagcaagcttaacggacaaagcagttgtacgctgttggccttgggagccaaaagtctgcacatttttgccgttaacaccaaattgtaaatcatcgcgatgaggacctaataaagtcgtcccttgaaaaatttctttggcttgttgttgctgatataaggcctgtagcgtttgataaatgtgatcgaccgacgtctggtcggcagttggcacttgagtgacatagtgaaacgttaattgttcctgttcttgcgtaatctcgctgtgaacagcttgcgcccatttctcaagttgctgcaacagttgtagtcgtttatggatgatttccgcaccaaatgcagccaattgatccgacaagacacccaaataaaccttatccttggcctgctgccgatttaattgccgtaagtattgattacgttgttttaaaatcgtgcgatactgacttaggttatagaggtatttagggctcatctgaccaaattccatatccataaaccgacggcgaaccgcgggtgcccctttaacgatggataaatcttcaggtgcaaacacgatcacgttcaaatttccgacgtactgggataatttggcttgctcaagatgattgactttcgctcgcttgccccgccgccccaattcaagttccaaggggacagcaccggtacttttatgtaaccggccttgcaacgttgccgtggtggtttgccaccgaattaattccttatcgttagcggtgcggtgactacgcgttaacgccaacacataaatggcttccaacaggttcgtctttccctgcgcattttcacctaatagaacattaacgccctgactaaaattaatggtcaaatccgcgtagttccgaaaatcatgcaagactaagttttctaagtacatctaatcagtcgtttcttgatttgagcgaataaaaaatgacccgttgtcttcaacttcaatcgtatcgcctggataaagtttccgaccccgccgatcatctggttcaccattaactaacacggttgtttcttttaagaaccacttcgcctgaccacccgatccaatgatggccgtttcttttaagagttgccccaacgtcatatatggggttttaatatctattggctgtttcacaatgtcacctgcctatctgattacaagctattaaacgactgtctggcgtgctacacacactcctaacaggttatattatacttgttttttgatgaaaattcaatttataaccgcactcagagccattttaagacgatttagggctttttaatatcgggatactagcctaggggtaaatttgctgaaattccctaattttgcggattttaataaaatatcttgttttttacctataaaaattggctaaagccagcattcattatctgaaagcgagcgtttgtagcgaacgagtgcaaggactggggttcatcagatggtgggattttagtagggcaacatcgatagttagcgtgacaattcaccagcagctaatataatatgcataagttaaaacttcaaaagttacatcatcgctattgcctattcattgccccatctttagctagttttagccgtcataaaaggcccgcatttcacggtgaaatgcgggccttttatttagaattgtatatttattcagctaattaaaacgttcgaactggtgtaatcaactgaataaagttttcgccttcttcagttggcactaaagtgaatgggcgcaatgccatcgtgaatgagattttgatcatagcttgcccaaacgaacgtaacgcttctttcatgtagtctgggttaaatgaaatttcaagttcgtcacctgacaaatcagtgggctgtagttgttccgttacttccccgacatctggtgagttaccgaaaatcgtaatcgttttgtccgttgggttaacggagaagcgaaccacattattgcgactttcgtgggataacagggatgcccgttcaattgctgctgaaagtgcgggtgctgaaatttcaacagtcgtattagattctttaggaatcagccgtgacgtgtcgggataatttccttcgagtaagcgagaatagaaggacgtattccccagcacaaataggacttggttttctgataaccgcatctgcacgtcaggattattgtcgccgatcatccgagataattctgtcaaacttttaccaggaatgattacatcataattggcattattggcttctggcaacttgatccggcgttgacttaggcggtgtgaatcggttgcgaccgctaagaactcaccgttagctaagataaaatgaaccccggtcagaattggtcgactttcctgattggaaacggcaataacggtctgaccaatcaactctttgagtacatccccagctaacgtgatggtattagtcgtatcaatttcaggtaagtgtgggtagttttcagggtctaagccgttgattgtaaaggaagcggcccctgaagtaatttgtgtttgaaaaccgtcgaccacgttaacagtcatggtgtcttctggtaatttttttacgatttcactaaagaaacgggcaggtaaaacgattgaaccggcatcttcaacgactaacgtattgttgtcatcacttgctggaatggtggtttcaatagaaatatcagcatcactaccagttaaggtaatagcgtcagtattaacgtcaagtttaagaccagtcaaaattggaatggtcgtttttgaagaaatggcccgttggacgttatttaattctttgatgaaggcagatcgattgatcgtgaatttcataagttaatcccctctttattctagcgacgggcactagatatatattaataataaaagttcgtagtaatagtagagcagtgggtactgtggaaaaccgagtaaagactcggcgttatcaagttttccacatgtgtataagttgtggaaaactttttgagttatccttttttatccacactaagatttgagctggcctgtcaaatcacccacggctttttgtaattcagcatcagttttgagtgccttagtgattttatcatgggcgtggatcacagtcgtatggtccttaccaccaaactcgttaccgatgcgcggaagtgaactttcagtcagttcgcgtgataaatacatggcaatttgacgtggaatcacgatttgtttattgcgtttctttcccttaaggtcagccattgttacatggaagtacttggcgactttttcctgaatgacgggaatcgaaacctctgatagtttactgctaaggtgcaaactcttcaatgcatccgccactaaactggtggtaatcggtgaattattcagtcgtgagtatgcctgcactcgtgctaaggcaccttcgagttctcgcacgtttgagtcgatctgaccggcgatataacttaacgtatcgtcagggatttcgatcccttcaagatcggctttattgcgcaaaatagcaatccgcgtctcgagatcaggtggggtaatatcaacggataatccccacttaaacctagaaactaggcgatcttggagttgcggaatttcgttcggtaagcgatcggatgtaagcacgatttgcttatcatcttcatataaagcattaaatgtatggaagaactcttcttgggttgcttccttattggcaaaaaattgaatgtcgtcgactaataacaggtcaacgttccgatattcttcgcggaacgcctcctgttttttagtttgaatggcattaattaattcattcgtaaaagattcgctagtcacatatttaatgttactagtcggatcggtttctaacaatttgttaccgatagcgtgcattaggtgggtttttcccagaccaacgcccccgtagaaaaacaacggattatacatggtgccgggttcttccgacacaactaacgcagcggcatgggccatttgattgcctttaccgatcacgaaagtatcaaaagtgtatttcgggttgagtttcgtttcccgcataaatgtgggggtagttgcggttgttggttgttgtcccgcaacgttaccggtagtcacttgcgagtccttgtctctcgtaagttgctgacgttcttcttccgttatcatgaccggccgaatctgctcgttagtcgcttgcatcgcaatgtccgtgaactttgcggccaagtttttctcccaatagtcacgatgaagttgtgttgggacttcgatcgtcatttgggctttatcgagttggagtggttttgccggttcgacaaacgtttgaaacgtgatcttggacagatcttgttccatagagaacttaatgagattccataagtcattacgttccagcacgtggataccccttttcttaaaaaacgtaattctattttagcatgaacatatagagttttccacaagtggacaagttaaagttaagagaattcacaggctgggatttgaatatacacagcttgtcgaaaactaggaatgaattttataaaacagcacttatccacaaaaacgagtttaaaactaaagccgcaataaaagcgtttatcggagttatacacacaacaaatacgccctgtggataactaaataacaacccgttaatttgtcgaaaaacttgtgggtaaattgcgaataacggaaagtcactttgctataatccacaaataaattcgcaattaaataattttttgacctcgaattactacggagaaatttaatttactggttttcaaacaaataaaaatatgctatagtagtcaggaaatgcgtttagatgtaaactgcgttttgaaaataacgacttaatcgaattgattcatgtcattatggagaaggaggtgtcatgatgaagagaacttaccaaccaaagaagcgccatcgtcaacgtgtacatggtttccgcaaacggatgagcaccagcaatggccgtaaagtgttagcccgtcgacgccaacgaggcagaaaagtattgtctgcataggccactgataatcagtggctttttctttacagtcctagaccaggtgtttagggctgtaaagttgtgtagcaattcgctcaagagcttgagcgcacacatggagatggattatgcgaaaatcatatcgggtaaaaaaagaaactgagttccaacaagtttttgagacccgcaactcgtatgccaatcgtcaatttgtcatttacgttttggaaaaaccggggcaaccccatttccgcgtcggtatttcggtcggtaagaagatcgggaacgccgttgcgcgtaactgggtcaaacgccggattcggcaatcaatcaccgagctaaagccgcagcttaagcaagatgcagactttctcgtcattgcccgaccaaccgttgctggtaagtcgcaagccgaaaccaaagcttatctaagccatgcgctaaagctagcgcacctgctggacaatgattaaagtgaggacattcgtttgaaaaagtacagaaaaatactggcaatgctggccgtactagcgatcgtactagttttgagtgggtgtagtaataccccaatcacggataagagcaccgggttttgggatggcttaatcatcttgaacttctcacgggcgattatttggttatcaaacttgtttggtcatagttatggtctcgggatcatcgtctttacgttgatcatccggatcattatcttgccattgatgatcttccaaacccgcaacatggtagccatgcaagaagtccaaccgcagatgaaggctttgcaaaagaagtattcgtcacgcgatatggaaactcagcaaaagctccaagcggaaatgaagaagttgtatgccaagcatggtgtgcatccaatggccagcatgttgccattactagttcagttgcctattttgattgcgttgtaccaagcaatctggcggacacaagccttgaagaccggttcgttcttatggttgcaattaggtagcaaggatccgtactacgttttgccaattctagcggcgatctttacgtttgctagttcctggttagcgatgaagtcgcagccagaacaaaacgggatgacaacgtcaatgacgtatttgatgcctgtgattattttgattacggccattaacgtgccatcagcgttgtccttgtactgggtgatttccaacgcgttccaagttggtcaaaccttgttattacaaaatccattcaagattaatcgcgaacgggaagctaagaagcaagctgaacgtgatcgtaagcgaacgcttgaaaaagctagaaagcgcgcgattcgtaatcataaacgttaaatacaagtagacctgccatgtgtggtgggtcttttttgttggttctgtatcatttttaccaatcggtcaatatgatttggactgtgatggcaggatgctaatgtgcgtttatgtaaggcccctggacggtccgtgatgaggaaattgtaatgaacgatcaaatactggtaatagtaatcatccggggatcaaggtgcctataaaaataattgtctgcaccatttgatcacatgtttttaatagcgtgccgcggtttgagagagctactttgtcagtcgtaattagaacgggcgattaaaaacgtaatgacccggcgcatgaaaaagtttcaaaaaaagatttgacaaattgaaaaatgaccgctaagatgtgaatcacattaaaaaataattagattaagcgaacggcagtcgaggagtcggttatcagtcagttacagcgagtcgcggatgatgaaaagcgatctgaactggtagctaaaagtcgattactagtgagaagttgcgtgaagcaatttccgggtgtacccgataacgtaccaacatatcgtcaataaatttggccgtatgtaagtggtgagtctgactggctcgcaaatgaggtggtaccgcgtgaagacgtccttttaagcataacagcttagtagggcgtctttttgttttgcgggatgccggttgatctgattaaaatcaaaacataatggagggattagagatgcaagcaaagtatacatatagcattataggggtggtgagcgccttattattaaccggctgcttgggggcggtctctaattcttcgaaaacgaccagtacggttgatcaaaataggacgttaggcatcacgattcctggcgaaccgatgacgactgatccaacgacttcgatcgaaaccaacggcggtgccgtaattacacagactggtgaagggatttaccgcaaaaacgcgaataataagattgttgcgggggtagtcgagaagaaggtcaagcctactgaaaacaagacccggtatacgtttacgattcgcaaaaatgcacgctggcaaaatggaaccaagatcacttcacaagatttcgtgacggcgttgcggcggcaagctaatccaacaacgaagtctcaaaacttggatgccattagttacatcaagaactttgatgccgttaataaaggaaaaatggccgttaataaattaggtgtgacggctattaataagcgaacgttttccatcaagttgagcaagccggtgccttatatgaattatgagtttacgagcttttacccactcaacacggcggcagtccagaaatacgggtctaagttagggagtaactcagcgacgacggtagcgaacggtgcctatgttattaagggctggaaaggctctaatgatagttggtattacgttaagaataagtactactggaatgccaagaacgttaagatcaagcgcatcaaagtcacggtcactaaggatgataatacggcgcagaacctcttcaacgccggaacggtccaagtgaccaacatttcggggcagtacgtgaagaataatgccaataatagtcaaatgacggtcactaaaactggccggaataattacatttatttcaatagtaagaagtccgtaactgccaatgagaatttccggcacgcgctaagcctggtcattaatcaaaaaacactagcaaaagatgtcttgcaagacggctcgcaagccgcgacgaacattgttccgaaaaactacgcgagtgatccgactactggtgaggattttgttaaggaagttgggaacttatcaccgactaatatcaagcaagctaagcagtattggcagaaggcccaaaaggaactcggcaagcaaaatgtgactttgaattttctatgcgacgatacggatactgagaagaaactcgctgaatacgtccagggcgtggccgaaaagtatttgaaaggcgtgacgatcaagatcgttgcggttccacacgcgacccacgtatcacgtgattttacggggaactttgacctcgtcacagtcggttgggggccggattatccggatgcccaaaactttttggatgggatgcagagctcgaatagcatcaactttactcagtggaaagatgcgaagtacgatgcgttgatggccaaggtatctaatacggcgaaatacacggccgcgcaacggtggacttatgaaaagcaagctgatcgccggttgatgaaactcgatgccgtgattcccacttaccaagcctcttctgcatttttggtcagcaaggatgttggtggcttgcaatgggatgaattttctggaacgtccagtcaacttcaatatgcttattggaaataaaaacttgtcatgaaaggtggtgaggcgtggtgaatagtcagttagagaaccaacaatgcagtgatgaaaatgatggtccgttaccgttaatgaacggtgtgcgacctgccaaaatgaaaggaagtcattattatgaccaaaaccaactatatcaatgcctcaatctacagttcagaaaagcaaacttttatcgataatcaattcatgactgttgacgacgcaaccggaaaaatcatcgcggtcggtacaggaaccccggatacgattgctgaacaaacgacagacatgcaaggaaagtatgttatgccgggcatcatgaatgcccatacacatattaccagtattccaacttactggtggcatgacggccaggaagaccgccatccggagtcacgtgagtataataccatgtatgcgattcacaatatgcaagatatggtaaaccatggggtaacctatattcgcaatgttggcgcccagtatgatattgacgttgcgatttcaaagatgcaacgagaaggaaagattgcgggtcctcgcgtgatgacatctggccaggccttttcaattacgggtggtcatggtgcggatggcggccacgaagtcgatggtgtggatgcggtcgttcaaggtgttcgccaggcccttaaaatgggcgtcgataatatcaagatgatggttaccggtggggtacttcgaaacggcgagaccccagatgatattcagtttaattttgaagaagttcaagcagccgttgctgaggcccatcataaaggcaagacggtggcggctcacgcgcaggggaatgccggggtaaaagaggcggttcaagccggcgtcgatactgtcgaacacgcctttgatattgatgatgaaacaattgagatgatgcggcaacatggcactgtgatcgtaccaacgatgaacgcgatgtatgctatttataaatatggcgagaagaccgttccagcatgggcgcgtgaaaaggtaatcgtcaacatcaagaagcattttgcaagtatcactaaagccgcggcggctggcattcccatcgcgatggggacggatgctggaacgccttataatggctttgaggatgaatcagcatacgaaatgcagctctatgtcgataaggcgggcatgactcccgcacaagccatcgatacggccacaatcaactgtgcccgtgcgatgcatgttgcggatgaatacgggacgatttctgctggtaaatttgcagattttattgcaatgaccgccaatccaatcgaagatattcgggttattcagcaagataaggatgttttccaacatggcattcaagttcatcaagcggctaaaacggccggtgttgatgagcaagttcctgtacggcaggtcgggtagtccgtcttattgagaatcagggctaagtgtgggtagtcttgattcgtcatatgaccagttagtgtactgacaggtgggctggttctggcttgaatttgatagtggtttgatttagtggccaatcagtaggtcagatgccgtgaattagtcggctaaaaatactagcattataaaccgattttctagtcattacggacgggaaaatcggttttattgagtttagagcagctttgatacggctcgcgagtggcaattagtaaatacggcaaagggaggctgtgggccgcgtctctgaaacgcgccatgaacaggttggttattgacataataagcactagattttgctagtctgagttttcaggggtagtagaacggccgaagtcctaatcgttgtaagggttcattaagtgttcatactcaggtgttcgcatggcgaatggtaatgctataatgaaagcaggatttttaacgaggaggattcaagcatgacagtatttgaaggtaataccgtcgcggccgcaatcgcggctggtctaaaacaactgcaccgaacacgcgatcaagttgaagttgaagtgatcgctgaagcaaaaaaaggatttctggggctaggcaaacaccccgcccaagtacggctaacggtggtgccagcctccgcagcacctgcaacgacgccaacttccgctacggcgacagcgcaacagtcagtagctactgaatcaacgacagcaccgaccatgccgcggcctaccgtgcggacaccaaagtcaacgccgaccagacaagctaaaactagtcaggccacgaccagtgccgcaaaaccagcgactagcaaggcgaaagcagtggctaaacccgcttcaatggcggttaccaccggcccggttatcgctgataccgaccaatctaaaccagcgaccactagtaagaccaaatcagtggctgctgaccagagccagacgccgcggacacccgcagaaattgcagcgcgccaagcagctaacgagaccgcggtgcgggcgttgtgtgattacttgcttgcggtggtcaaagaactaggtgtcacggcggatcttgacgtcgacttcggcaaccgctatgcgacattgaatttcgatacaactaagcagggtttgctgattggcaaacacggtcgaacgatcaatgcactgcaagatttggcgcaagtttatatgaatcatcatggtgcgtcacacgttaacgtggtgctagatgtggatgattatcgggagcgccgggctgcgacacttaagcggttagccgagagtacggctcgagaagtgattgcaacgggcaaacaagttttcttggacccgatgccatcgtttgaacggaaattaattcacgctgaactagcgaataatcaccatgtaaccacattctcagaaggccgcgatccgcaccgggccgtggttgtagcgattcgcaaatagtttattcaaagtaacgcaaacaggcgtttgacaaactccgggtgagctattatagtaggtgttaatcattcttatcttttagataaagtagtcaaagtgctttatccacgctttaaggtggcgtggactaggcgctttttttctgcattttaggacatattattaactaattgtaagtaaatttggtatggtattaggcgatgaaacgctgacaagaaaggacatgatggtatgccaacgaccacagaatttgacacgatcgcggcaatttcaacgccgcctggtgagggtggtatttcaattattcggattagtggggaccaaacgtttaacgtggtgacccagatttttaagggtaaagatctcagtcgagtgcaatcacacacaatcaactatggacatattgttgatcctgatacccatcaggaagtcgacgaagtcatggcgaccgtaatgcgcgcgcctaaaacctatacgcgtgaagacgtggttgaaatcaactgtcacgggggactcgtggcaactaatgaaattttacaattgatcttgagtcacggtgcgcgaatggcggaacccggtgaatttaccaagcgggcattcttgaatggtcggttggacttgtcacaggcggaagcagttatggatctgattcgtgctaagacggataagtccatgaaggtcgcgttaaaccaattagatggtgatctatctaagctgattcgacatttacggcaagatattttggacgtattagcccaagtagaggtcaatattgattatccagagtatgacgcggttgaaacaatgaccaccaagatgctgaaggagaaggctaccgaggtcgcccaaagcattaatcaactgttagcgacggctaagcaaggtaaggtcttacgcgaaggtttggcaacggcgatcattgggcgtcccaatgtcggtaaatctagtctgcttaaccaccttttgcatgaagacaaagctattgtgacggatgttgccgggacgacccgcgatgtgattgaagaatacgtcaatgttcgtggagtgccattgaaactcgtcgatacggcaggaattcgggacactgaagataaggtcgaaaagattggggtcgagcgaagtcgcaaagcaatcggggccgccgatttagtcttattagtgttggataatagccaaccgttgacggctgaagaccgagagttgttgcaagagactgaccagtcaaaacgaatcgttatcttgaacaagactgatctaccagcccgtcttgatcaagctgaattggcgcaattagtcgatttgagtgacgttttaagtatgtcagtcttggaacaaagtggcgtcacgcaacttgaacaacggattgccaagatgttcttcaatgaaggtatcgaaagtagtcaaaataacgtgatggtgaccaatgcgcgtcacatcggtttgttgaatcaagccaaacaagcgttgcaagatgttcaaacgggacttgcggctggtatgccagttgatttggttcaaatcgatatgacccgttgctgggaattcctcggtcaaattaccggggatagctatgaagatgaattattagaccagctatttagtcagttctgtctgggtaagtagtggtaggaggaaattggaatgacagaagtaaagcagtacccaggccgcgactatgatgttatcgtcgttggtgctggtcatgccggttctgaagcagcattggccgctgcccgaatgggtaaccggacactcttaatgacgatcaacttagacatggtggcctttatgccatgtaatccatcggttggtggtccggctaaaggaattgtcgtccgtgagattgatgctttgggcggtgaaatgggccgtaacattgataagacttacgttcagatgcggatgcttaatacgggtaaaggcccagctgttcgagctttacgggcccaagctgataagcatgcttaccatgcggaaatgaaacacacgattgaacgggaacctaatctgacgttacggcaaggaattgtcgatggcttaattgttgaagatggggtctgcaagggcgttatcacgaatacgggagcgcgctatagtgccaagagtgttgttttgacgactgggacggcggctcgtggcaagattatcattggtgaactaatgtattcttcgggtccaaataattcgcaaccagcgatgaagttatctggtgatctggaacgacttggatttaacttggaacggtttaagaccggtacaccaccacgagtcgatggtaatacgatcgactacagtgttacggaagaacaacctggtgatcctgaaccacatcattttagttttgaaacgaaggatgctgactacattgatctaaagcatcaattatcttgctggttaacttatacgaatgagacgactcataagatcattcgtgaaaatcttgatcgagcaccaatgtttacaggcgtgattgaaggggtcggaccacggtactgcccatcgatcgaagataagatcgtgcgattcgctgataagaagcggcaccaattattcttggaaccagaaggccgtaatacggatgaatggtatgttcagggcctttcaacgtcgatgccggaagaagttcaacagcggattttacattccattaagggtcttgaagatgctgaaatgatgcgcccaggttatgccatcgaatacgacgtggtggcgccttaccagttaaaggcaaccttggaaacaaagttggtcaagaatctctatactgctggtcaaacgaatgggacttctgggtatgaagaagccgctgggcaaggattaattgccggtatcaacgctggtttgcgagcccttgatcgtggtcaattcactttgaagcgtagtgatgcttatattggagtcatgattgatgacttagttactaagggcaccaatgaaccctatcggttactaacgagtcgggctgaataccggttgatcttacggcatgataatgctgatttgcggttaacggataagggccgcgagttaggattgattgatgatgaacggtatgcggcatttgaggcgaaacgccaagcaatcaagaatgaacttgaccgtttaggcaaaataagaatcaagcctaatgatgaggtcaatgctttcttacgtgctcataattctggtgagcttaaggatggtgtgttggcggcagatttcttaaagcggccagaggtacaatatgctgatttaatgaaatttatcccggcagcacccgaaccactagaacggcatgttattgagcaagttgaaattcagatcaagtatgccggttatatccaaaaagcagaggaacgtgttgatcggttgaagaagatggaagctaaaaagattccggatcggatcgattatgatgcgatcgacggattagcgactgaggctcatcagaagctaaagaagattcagccgacaacgattgcacaagcttcacggatcagtggggttaatcccgcggatattgcaattctgagtgtttatattcaacaggggcgaatcgctaaaattcaataatcatcagtagtaggttatgactggtgtgttcagttgatattaacgaatgatgaaagaaaaaattaatatttttaacgataaagcacaattccaacttggaattgtgcttttttagtgagcttactttttaattagtacacgtttcattaaaaaaacaacaacactttaattaatgatgactaaattaaattaaggtattatacttcagaactagtaaacattgtttacagtgtttacaaaataaagggggagttattgttggtaagagttagtaagttagtcagtggtattttagtggcaagtagtttattagtgagttcgggtgtcatcgctcaggcagatacgcccgctgctcccaacgcagatagtacggccaatacgactggtacgactgatattcaggcgatgtttaaaggaaatagtagtccggtatcaccagttaatccggataatcccaataagcctgataatagcggtgatagtggtaacggtgctaaagccggtggcggcttatcgctgatctacgtttctaataaattagattttggaagccatgagatcgatgttttaaatccagaaacgtacactgccgcagaaactgattcggatttatcaggcttatggaacaaaaaagcagtcacagaagtatctgatgtccgaggaagtaatgctggttggacactggccgttgccgggagtagtttgactggtacagacggttctgtaatgaaaggggcaacgcttcagctaccaaaaggtacggtaactaattctggtgcaactaataatggcgtgcagtccactgaggctcttaatgtgttagatggtaattcggcgacagtattatcggcagcgaaagatcatggtgctggtgtaactgttgatcaaattgatccaagtaatgttaagttaacggtgccggcaaacacggctaaagcgcaggggtaccaaacaactttgaactggagtttgagtgatacaccagcaagttagttagaatataaccaaaaggggaagctaaagcagatggcgatggctaacggttattatggataaagtaatcgttgatgtaatcgcgagcagtggcttcccttttattaaatgatagctttaaaagatgcgtcataatatggggtgtgttgagattgaaagtggttatccaattcataagactaatgggtgtgagtcttggatttagtattttaatcggacagacaggagtgtcggctaatcggcaacaatcggtccacaacaacaatgtcggttttagtgttgccgctgagataccaaaaaatcagattcataaacaaaattctttttttgatttgaaaatggcaagcggtcaacagcagacgttacggacagtcatttacaatgtcactaataaggatattaaggttcgaacggctattcataccgcgtatacgaatactaatgggacgattgaatatattaatccggccaaatcgtacgatcagtcgttaaaataccgagtcagtgatttagccacaattcagggtgagcggacaataacgattccggctgaaggctccaaaacggtcgcaatcaaggtgaagttacctaagcagccagtaaatggcgtcttgttgggtggatggtattttaaacgggttgatgacaaggtaacaggagtaacggagaaaagtatcaacgttaagaatgagtattcgtatgttattgggttgaaattatcttcaggaaaattgccaattcctaatttgtgtctagggccggtgaaagctggcttgaacaattatcatcgaagcattattgttgcgctacgtaatcctgtcgcaagaatcattccgaatttaaaaatccgaacggtgattattaataagcggcatcaaaaggtcattattaagaatacgaaaacgggtgtcatgatggcgccaaacacagtttttaaagcaccaatgccattaggatcacaacaattacaaccgggtgattatcagttacaaatgacggttaataatcagcgtcatcattggcgatttaaacgagattttcatattagtatgacagcagctcaaaaatataatcatgagtcaattgataataagggggttagtatgtggatgctaattggaattggcgcaatttcaatgctagtactggggttagggttaggcgtaatcgtctggctatggcggcgacaacggcggtcgaaggattaggttaattaatgggggtaggatggtgcaacggtttagcgtgtgtgtagcaaccattttaatcagtttaataatgttaacaataacgggagttgcggccgttggggggcggtcaacagtcaccgttagcttttatgctggtcagagaactcagcaacagatagataatcgcaacgttaagattcctaatgggaccaggccatatcgtgtggtgacagaaaagacgttgacaagaccaaaggggtattatcaattgccacagactgatgagcagctcttaacctggttttatgcgagtttcggtagcgtgctactgatattattgatggttatccgttggtttaataaagaaagctattgctaggtaaggagggaccgtagaagtgagaaggttacttactggcacgttggtcgtgggtgggctgttattggtagtttgcctcatggctgttaatgggcaggcaaaggttgtcgatgagccgaccagtgcgatgcaggatattacaactaatttcgaacaacgaacaattggtcgagtgccatggcccattacacacattgcggctaattatgtgcgagatggtcacatgacgcacaagactagtcgagtgaaaattactttaggtaaaggtgtagtacattcgccgaatggtaagggattatataatttatgggatctggttttgaatcgccaaggcaaagagtatggtgcaactttcctggcttataatatcaataatcgagtttggcgaccgcatcgaacagatactatcaagacgcatggaatcaaagcaggtcagccggtttggattggtaataagagcagtactaatgcgagcagtaatcccattcgaacactgcctgcttacatggtaacgaagcagtactgtcaaatggttagtcagattaaattatcaccacatattactggatttgaggctaataagcgcatcattaccgggacgggcacacaaggtggtgatctaatcacggctaaatttggtaatcagatcaaaaaaacacgagtcgatcatgaggggcgctggcagatgaaatgctttagcggtaatggtcgcttgatggtaacggaaacaaatgcgtatgatgatattccagggcacactgaaacggtgattaataacggaactccacgaacggatgcgacgattaagctcaacttgtttttaactaatggtcataccttttcaaccgctaagggacgcaaggtattagtgaccggaatgatcttggggactgatcagaatgattttgatcgcgatgttgttttaaaaaataacgcactaaccatccactttgcccatgctgatggaacgcccatcgctaattataaggctaatggttcggtgaatgagccagataaggcggggtattttcatctgaaattacccactgaatcgcttaaacaagggcctaatgatgtgaaagtgtgggtgtcagatcaacacggccaacgatctaatattgatacgttaacagttaatgtaaattcaggactcatgtttggtcaaatcaatgctcaaatgcgttttcggagtaacacgattccacaaagcgagcgcttattatcgcccacaaatcagtggcaaattgaggttcatgatacgcgatcagttgcttcaaagtggtatgtgtatgccaccgcaactaaaatgaagtctgctcaacactcattaattggggatttggtctatattgatgctgctggtcaaaaacatgtgatgaccaatcaggaaacgttggtaggccatggcacacatacaaatcctaatcaacaaactactaatattgcagcaacctggcaagcgcgacaaggtatttttctcgatgttcagcccgaattgtatgcaggatcctatcatggaaagatcaattggagtttgcaagatacaccacaatcttgatgagtggaagaaagatgtcatcaagatgtgttagttagtcattaaggaaattatgaatgaccgtcaagattgttttggcggtcattttagtgtgatatcgttgcaaggttacttataaatttgtaaaaacgattcaccaataccagacaagctgagttgattggactataatgattggaagttatagcggggtaagggagaacgtttgatgaaaacttttaagagtattatgagctgggtactaccaattgtagtggggttactcgtcgccatggtgatcaggcactttatttttacgatggttcgggtggatggaccgtcaatggaacctaacttagatgacaatgagcgcgtcgccgtggtcaagacagctaagattcagcacctcagtgtcatcgtttttaacgcctatcaagttgatccagacgcacgctccaagacggtcaaatatgtcaaacgagtgatcggaatgcccggtgatacagttaaatctgaagacggccgactctatgtcaatggcaagcttgtcccgcagaagttcatcagtcagtatgagcggacgcagggaacgacaaattgggatttgagtacgctggagaaccgttacagttggaatctgaaaacaactaaggtccctcagcattcgtactttgtgttaggtgatcatcggtcagtgtcaaatgatagtcgttactggggatttgtcccagccaataaggtgttgggcgtggtcaaagtgccattttgggactcgaataagactaagcgccataatattaattcaattagttactgaatagcagccagcgcgactcgttagtgagcgcgcttttttttgtatgctcaccaactgaatggtagggggggaactaggttacttagtcattctttacagggagaacaatgtgggatggttaaagtgactaatcttgttcagaaaagcaaacaaaaggtagcatctaaattgaatttaatggtcaataagcctagaataatggcaagtatcacgatggaggttggtaaatatggcaactgaactaacaccggatgcacttgccgctttacggacaacgcatgcgcaggatcgaatggcaccagtattgacgcgagcgattacgaagaatgggattgaggctgcaagttttgataatcaagctgcgagtcgcttagcgcggactttttctgttgaagtaccaacgggtaaggtcagtaatcagaagcacagcggtcgttgctgggagttttcattattaaacacgctccggcataagtttgcgacccggtatcacgtcaaagactttgagttatcacaaaactatttgtttttctgggataagattgaaagggctaatattttttatcggaatgttgaacaaacggcgcgtcagccgattgatgaccggcttgttcagttcttatttgctaatccgggcgaagatggtggtcagtgggcgatggcggccagcttggttcaaaagtatggcgtcgttccagctagtgtgatgccagagtccttcaacactgataatacgacggcatttcaagccagtttatcacggcagcttcgtaaagatgggttaaaacttcggcaactcgtgatggatggtgcaagcgaggccgagctacaatcactggagaaatcaatgttgcaaacggtctatcggatgacggcgtactcatttggtgaaccaccaactagctttgatttagaatatcgtgatgatgagcaacagtaccatcgtacggctaatttaacgcctcagcaattctatcaggactactttgaaactgatctggatgattacgtggtcgttactaattcaccagataagccgtttaatcgactttatagcttgccagacgaggataacgtgattggtggtaagcctatcgaatttttgaaccttgatatgggtgtgctgacggacgttgctgtgcaacagttacaggctggcgaaacggtttggtttggcaacgatgtgttgcgacagatggaccggaagacgggatacttggatgctcatttatttgaaactggcaagttatttggaaccaacgatcatctgactaaggcgcaacggctgttaacaggtgaaggtgaagttagccatgccatgacgttaaccggcgttgacttagtggctgatacgccaactaagtggaaggtcgaaaatagttggggtgagcaagtaggtgatcaaggctacttcgtaatgagccaagattggtttaatgagtacgtctatgaagtagttgttcacaagcatttcttggcaccggaatttcaggcgctgcttaacgaacgtgcacagcggctacccgcatgggatccgttgcactaggagggtaatgtgatgggaatattttcagaacgattaaaagaagcgatgcaacaagcgaacataacctctgctcagttatctaaacaaacgggaattggtcgttcatcaatcagccagtggttaagtaataaatacgtggctaaacatgataaggttacggcgttagcggcggtactgaatgtgtcgccagattggctgctaggtacgactgatgttgcaacagcggtgcccccggaagcggtaccgattccagtatcggtcacgccaacctctgccgttgaccccgaattaataacattgtgggaacagctggataccaaacaacgatctaagttgatcaaaaaggcacggaagttgttgactaaatcggccgaacagcccaacacaaagcggaaaaagaacaagaaaaagaaaaaaggcaagaaacggaaataaggcaatgcaaaaaacaacttttgctcctcagctcgtcgtgaggagcaaaagttgttttttgactgtcatgatgaattatcaggggttgataatggtgaactaaatggtccatttttcccagtcacgcgcccaaatcagtcccatgacgccttctccaacgtgaaccccaacgacgggaccaatctcgccttcatcgatggtgagatcaggaaagctagccttcaagtcagctgtccattcggcttggagtttcggattgttgccattttcgattgtgacgcgaagtggatagtcaacggcagcaatctcagcagctagcttggctttgatggctgcgtatgcccgccgcatcgttcgttctttttgaatagcgacgatcttgccatcttgaaaggtcagaacgggtttaatgcgtaagaggttgccaacgagtccagaagcgtttgagagccgaccagtccgaaccaagtgactgagattatcgacaacaaaatatacgccggttgtttcacggatttttttgagctgagcaataacttgttcgggtgagtatccttcagcgactaatttagcagctaacaagaccatgtaagcttctccaccagccgtaattagtgaatcaaacggataaaccttgatgttggttacgtttggcaggtaactttcgagattagtaataaagctggtgataccagaagaaagatggatactaatgacagcatcatagcccgcctttgccagctgatcataagtcgtttgcatctgaccaagggtaatctgagtggtcgttggtaactcaggcgcggtacgcattcgttcataaaattctttggacgttatttcgacgttttctaagtaggtttggtgaccaaaaataacagtaattgggacgacgtgaatatgatacttttcaacatcggccgctgagaggtagcttgcgctatccgttacaattgcggttttcatttttcccccgctttcatttggtgaaagtattgcctaacattataacgcttgtcagtagttgaaagctagctttgatgaatagattaaggcgattaatgtttgaaattctcaacaactaacgtcataatgagaatcattaaatgggggagggcgcaggatgaccaaacgaattgagataaaaccggcaacagctgcggatcaagcagcgctggctgaaatatatttagtggaccgtcagcaagattttccatgggtcactgatccacaactgcaagattttaacgaagacagccgtggtgaattcgtgctggtcgcgtggattgatggtcagcgggctggcttttgttcgttgtaccggctggccaacttcattcatctgctttttgtggccccagatttccgccacttgaaagttggtgaacggctactgacagaaatgcgccagtatgcaaccgaaccactcacgttgaagtgtgtgatggccaacgaaaatgccctgcgattttatgcgcaagtagggtttcgaattgtcaaagcagatgcggacgcgctcccaccaaattatacgttgcgtgatacgcatactgagcagtacgtggcattagtggatgttatggccaatgaacgcaaacttaattaatctaatttatttttaattttaaggttgacattgtgataatctggcgctagaatctaatcattaattaaatttagattaaaaaccgtgataaggaacggtgttaagctggttagttagcgagctgcggattggtgtaaggcagtcaataccacttaacatagatcaccttggagttgcgcctcgaaattcgtggagatggtgctggatggtacccattaatgtaccggcgtatcgcaattgctgtacgtactaaggtgactattgtgaagtagtcgcgaataaaggtggtaacccgttctggacgtcctttaattaactcataggagttagttaaaggacgtttttttatgatttaaaggtggtgaggagtatggaatcggacattcaggtggctagttaccaacaaatgtgggcaatggtaactagtcgcacgaggacttgctcctcgagtaacacataggtcaacaaggaatcaaaaacacatagtataactgagtactccgggtagatcacatacgataccacgtgtatcgattaacacatagttttagcaacgtgcaatttatacgtttaggcacacatagttttaacatgaacgatatttatgacccgtagtcttaataattcgtatttaagacgcccgtacaattagctggcgcactgaatacatccaaataatgaagtgacaactagattaattgtaatgagttaacgtattagcaatggttagacggcctcattacgaacacatattaggataacagtaaccacaaacacataatggaggttttataatgacaactaccaccacagaaacagaaactcaagttgcacaacagctatttacggcctatcagacacagcatgcgttaacaatggctgattttacaagtagtgtcgctgacgaagacgctgcgtatcgagttcaagccgcattaacggccttaaaacagcagccggttggtggatacaaggtctcgttgacgagtgcggaaactcaaaagatgtttgatgctcatacgccgctgtacggtgcccaggttgcagatcactttttggcggcaccaaccacggttcgacgcgggcaactaatggacccactcgtcgaagttgagttggtctttaaggctaaagaagccctgtcaaccaccgattcattgaccgatttatggcaaaaaacgactgtcgcgccgggacttgaattgccagattcacgttttgctgactggtttcccgatttgcctaaaaatttggtggtcgcggatgccgcagtcggtgggctagtggtatatggaactgaacgggagactgccgagttattcgcttcagctgatgcagtggcaacgccaaagtgtacgctagtccatgatggggaaacggttaaaactggtcaagcgagtgaagtgttgggtaacccgcttgagtcattgaagtggttagtcggcaagcttgcagagcaaggtaagacattaacggctggtcaacgagtttcgtcggggacgtttgtcctaccaccacatttgaccgcggggcactggcaagccgacttcgatgccgggctgggacaggttgcgctggatgtaacagaagcctaagtaaaataatcacgaaaaaggccttcataaatgtcatgacatttatgaaggcctttttgaagtgttgctaaatgaatgtttttcagatgattagtaattttcaaagattggacagactgctaattatccaatttgtagaccagaatgtttcacgtgaaacattacttatttaaacgatggtagttttgatcaaagtacttgccgttgcgaatatcattcggcatttctttgtaaggtgcttcactgattacatcttcattgttttggccggcgtcgcccatgtaagtaatattggcaaattcgggtacaactagttttggataagtggcatacttttcacgagactgttccattaaatcgatgtgttcgttttggtaagtgaccgtaatttcagggtgttcttcaacccactttgggaagaaaatcgtaccgtgtagtttcttctcattgggcatgaagtctagtgcaacgtcagtcccagttggttcagtccaagaaattttgtaaatgccttcggtcaacatgacgatgtcagctttttgatcagtgacccaacgaccggcaaccatcccaccgtggattcggtaatcaacggtgtggtcgttcttggcgtaccactcgtattcccagccgttatcataagtgtagataaagtgtgtgccgagaaagtcatcaagtgttttaaaagtttttgtcattagaattaccttccttatgtctaatatgtcattttaatcatgtaatttattacatgttttaaacaacaaggttagtgtatactgttatcaaggaatcgtcaaggaggaatttccaatggcgcaaaaaaacaagttacaatttattattctagggttattaaaccagcaaccattaacgggctatgatctaactaaagcctttgatgacgagatcggtgaattctggcaagctcaacatagtcaaatttatccgcaattgaagcgactagaagaacaaggttacgtcacgcatgaaattacggtcagtggcgaaaaacttgaaaagaaactctaccacatcaccgcaactggtcggcagctgttacatgagtggatcagtgtcggtacaccagacttaaccgctacgaaagatgaatttattttaaaactatactttattcaaacggatcgtgatccacgcctactagcgatgttacaggaacagctcaccctgcacacagctaagttagcacacttacaacagcgattggcgaccgttttcccgcaagctaaagctgctaagcaacattatggtcactatttgatcttacaacatgcgatcggacgagaagactactatgtgaattggttgaagcagacgttgaaagccttaccggagtaatggggagagtgctgccgctctaactggtggctggaatcatagcgttaaaagctacccttaattatttagagcggcgtttgaaggaaatcagcttatgattatatgcgtgtgagaaatggtgccgtttgaattctgaaactggtataatggcagtggtcaatatcaattcacttcaatgaggagattaactatggaaaatcaaaaaatgcaagagccacttgtctatcggcgaattttactgaccgttgatgaggacgataatacctcttcagaacgtgcgtttcgatacgcaacgactttggcccacgactatgatgttccgttaggaatttgttcggtgctggaaagcgaagatatcaatatctttgattcattaacaccgtcgaaaatccaagctaaacggaaacacgttgaagatgtcgttgccgagtatattcagcttgctgaacaacgaggcgttaatcaagtagagccgcttgtctatgaaggcggtgatgtggatgacgtcattttagagcaagttattccagaatttaaaccagatctattagtgaccggtgccgataccgaatttccacattctaagattgctggggcaattggtccgcgtttagcccgaaaagcacctatttcagttatcgttgttcggtaatcaagactcgggacagggattaagatccaagctgatgaaatttgggtctatgatatttagtgttgatggataaaatccatcaacactatttttatgtacaacaaaaggacatatcgtcctgtgctacaatcaagtcgaccaaaaccaattgaaagcgagtgtcagatatgtcccaagaccattctactaaagtactgctccaaattaaagacccaaatattactgatttagttgttcaagaagctactaacggaagcttacaagtgcttgcaaagctaacgtatccggttactgtttgcgcacgttgtggcaaacgttccatggttaagaatggctttaagacctcacatcagaattcctagaattagcgaacgagtcaccatccttaacttaaagaagcagcgatttatctgtaaaaattgtggtaaaagtagtttaacaacgactacgctggttaaaaaacatcatcaaatatctgaaaacagtctgcatgccattgatctatcattaactgaagaccgtacgatggctagtattgcggctcaatacaatgtctcgaccaatacgattagtcgccgaataaagttactcggacaaggtacccaaccagctttcaacggactaccaactatgctttgtatcgacgaatttcgttcaactggtaaacaaatgagttttattgcggtggatgcccaaacccacgacatcattacaattttaccaggacgtaagaatgccgatattaaagacttctttctcaatcattattctaaacgtcatcgtgaccgcgtaacccgggttgtgatggactttaattctcaatatcaacccgcgattcgaacactctttccacacgccaaactagtcgcagataactttcatcttgttcaaatggccttacgatctttgaatcaaactcgggtccaactcatgaaacgctttaaccctaagagtcgtgaataccgagtgcttaaatattattggcggttatatttaaaagattatgacagcctcgaaaagcgcaaacctcaatggtttgcgcatcttaaagatcgcatgacaccagagcaattagtcgtagccagtttaaatctagaccaacagtttcgacaaacctaccaagccgcacatgccttagttaaggcttttcaaaagcgtgattatcgatccttcaaagcagcactaggtcatgtcgaaaatgtcagtcctcagctaatgaccaatattaaaagctttatcaagaaccggcaactcatcaaaaatatgactaccggccgattatcaaatggtcccgtcgaaggtgtgaaccgtaaaatcaagcaaatcaaaagaaccgcgtatggttacaagaactggcaaaactttatttatcgaattcaaattgagttcaaaatcaaaatcgaaaaaaagaacccaattcgtaaatgaattggattctaaatataacttcatcaacaccggttgacagagacccaatataacttcatcaacaccggttgacagagaccctgaaattttaacaaccgcaagctcatcatggctaatgaggagcttgcggttgtttttgactgcgattgttcattaatgaacttaacgattgagatttttaattggctataaatgttgctaaatatgagtttataagtgtactatttggatggcattaaataatttttcaaattcttgttgcattatgagcaaggatggctataataaagtttgtaaattaattcacaaaggaattgaacggaggaagcacttcatgattaagacagaaaaaaatcaaacaagcaaagttactgacgaagttgatcaattagttcaacgttctaagaaagcattagctattttgaagtcatacacccaagcacaaatcgatgatttatgtgaaaaggttgcggttgccgcactggacaatcatatgaagttagccaagttggcggttgaggaaaccggtcggggtgttgttgaagataaggcgattaagaacatctacgccagcgaatatatctggaacagcatgcgccatgataagacagtcggcgtcattaaagaagatgatgaagagcaactaatggaaattgctgaaccagttggtatcgtagccggggttacacccgtaacgaatccaacttcaacaacggttttcaagacgttgatctcattaaaggggcgtaacacgattgtctttgggttccatcctcaagctcagaaatgtagttctgcggctgctgatgtgatgcgggaagcgattaaagctgctggtggtccagctgatgctgttttatacatcgaacacccaagcattgaagcaaccgacgccttgatgcaccatacggatgttgcgacgatcttagctaccggtggtccaagtatggtgacagctgcttactcatcaggtaaaccagcactgggtgttggtcctggtaacggcccaacttatgttgaaaaaacagctgacattaagcaggcggttaacgatattgttttatcgaagacgtttgataatgggatgatttgtgcttctgaaaatagtgccattattgacaaagaaatttatgctgaagttaaagctgaatttattcgtttgggttgctactacgttaaacctaaagatgtgcaagccttgagtgatgctgtcattgatcctaaccggcacacagttcgtggtccagttgctggtaaaacagcttatcaaatcgcacaaatggctggcttgaaagatgtcgctaaggactgccgggtcttgattgcggagattaatggtgtcggtatcaagtacccattatccggcgaaaaattatcaccagttttgaccgtttacaaagcggattcgcatgaagcggcgttcaaacgggctaatgaattacttcactatggtggcttaggccatactgctgggatccatacgaccgatgatgcattggtcaaagaatttggcctacaaatgccagcttgccggatcttagttaacacgccatcttcagttggtggcttaggtaacatctacaataacatggcgccttcattaactctgggcacgggatcatatggtggcaactcgatttctcataacgttacagatatggatctgattaatatcaaaactgtggcaaaacggcgtaataacatgcaatgggtcaaaatgcctcccaaagtctacttcgaacgcaattccgttcgctacttggaacacatggccgggattaagagggttttcctagtttgtgatcctgggatggttgaatttgggtatgctgaccgagtaacgacggttttgaacaagcggactgatccggttgatatcgacatcttctcagaagttgaaccgaacccgtcgactgacacggtctacaaaggggttgcccggatgaaggcctttaagccagatacaatcattgcactcggtggtggttctgcaatggacgccgctaaggggatgtggctcttctatgaacacccagaagcttccttcttaggtgctaaacagaagttcttggatatccggaagcggacgtacaaagtaccagtatctgaaaaagtaacttatattgggattccaacgacttctgggactggttctgaagtaacgccatacgcggttattacggactccaagacgcacgtcaaatacccgattacggactacgcaatgcaaccagatattgcgatcgttgacccacaatttgttgaaacggtgccaaagcggacgacggcttggactggtctcgacgtaattacccacgcaaccgaagcatatgtttcaacgatggcttctgacttcacacgcggctggtcaattcaagctttgcaattagccttcaagtacttgaaagcttcttatgatggtgacaagatggctcgtgagaagatgcacaatgcctcaacgctagctgggatggcctttgccaatgccttcttgggtatcaaccactcgatcgcccataaattaggcggggaattcaacttaccacacggattggcaattgcgatcacgtatccgcaagtcgttcgttacaatgctgaaatcccaacgaagttagcaatgtggccgaagtacaaccataatactgccttagccgactatgccaacattgcccgggccttagggttaccaggcaagaccgacgaagaactcaaagaaagcttagttaaagcttacattgacttggctcactcaatggatgtgaccttatccttgaaagccaaccgggtcgaaaagaagcactttgacgccaccgtcgacgaattagccgaactggcctatgaagaccaatgcacgaccgctaacccacgcgaacctttaatcagtgaattaaaggcgactattgaacgtgaatgggacggccaaggtactgaaaaatagccctttgtgaattaagggagcccgcgctcatgatgagcgcgggcttttttgtcatgtggttttagaataactacctggaaagtttttactgtttgttttcagaggaggagaaaatgaagacttgatatggataaattatcggcttgcacactatatagatatacttataggtgtactaaatatttttgagattcggttaggaaaattcggcgttctaggctacaataatgcaagagttaattttacggaggagaagcccatgaaaaataaggcagtcacaatcaaagatgttgcgcgccttgcagaacgctcaattgcgaccgtgtcacaaattttaaacgggcatggtgataagtttagtgcggcaaccgttgctaaggtggaagcggcccgggatgaattaaattatgagcctgattactttgctcagcggatgattaagaagaccagcaaaacaattggggtccttgtgcctgatattcggaatcccttttttggtgagctgcttcgaggcattgaaaacgtcttgtatcagcaaaatttcatcacgatgttgtgtaatgctgatctggatgaagacaaagaacgcgtctatttggatgaactcagccgccggggtgtggatggctttattatcgcaagttcggccgtttccaataatgcgattaatgatattctacggcaaaagggtcacccatttatcgtcttagaccaaaagcgcgccgaagggttcagtgattctgtgttgactgatgactatgatggggggcggcaagctgctcaacacttaaaagatttgggacaccggcaagtcgccgttcttattccagcaaaaccgtcagccaatgtccaaaagcggcttagtggtttttatagtgtgtatccgcggacagcggtacatgtcatcgcgacgccgctttctaaagtgggtggtcgccaagttgttccggaaattttggcgactggggttacggggatctttgcagtcaatgacgaaatcgcattcggtgtatacttaggcatggctgaacatgataagcggataccggatgattacagtgtcattggctatgacgatgtcgaaatgtgccaatatgtcgcgccacagcttacaaccatcgcacaaccgatttttgagttggggcaaacgacagccaaccagttactcgaccgtattgctaatccgcagcagccatgggaagaacaccacttaccagttaaattaattgaaagaaattcgacggcacatttgaattaattattcagatgtgttatattttttacgagttattaaaacgttttcataaaacgttttaataaaaactaaattcagattaatttaactatttggagggaccattatgaatacggtaaccgttattgggagtatcaacttagaccggacgattcgggttgaaaacatgccaaagcctggcgaaacgattcacactaaggaaatcttttcagccggtggtggtaagggcgcgaaccaggccgtcgcagcgcaacgttctggtgctaatacccactttattggtgcggttggtgacgatgctgctggtaaaaccatgcttgatttattgacgcaggaaaagatcaacttggcagggatcacaaagatgactaatcaatcgacaggtcaagcttacgtcacggttgatgatgccggtgaaaaccaaattatgattcatggtggtgccaacatggcctttacgccagcagacgttgaagcccaccgtgatatcattgaaactagtgattttgtggttgcacaatttgaaagcgctgtcgatagtacggtcgaagcctttaaaattgcacaggccgctggcgtaagaacaatcttgaatcccgctccagccatggaaaaagtccccgctgaacttttagcagttactgacatgattgtaccaaatgagacggaaacggaaactttgactgggattgcaatcaccgatgaagccagcatgttaaaggcgtccgctgcattacacgccctcggtatttcagctgttatcattacgattggtagtaagggtgcgttttatgatatcgatgggcgacatggtatcgtaccagcttttaaagtcgaagccgtggatacgacttcagccggagatacgtttattggcgcgatgagtagtgtgttaaataaagattttagtaatcttgaagatgcgattcgctatggtaaccgggcgtcatcgattgccgtacaacgtttcggtgcgcaaccatcaattccttataaaaatgaaattacagccgcggagggtaaataattatgaaaaaaacaaaagttattaattcagatttgtcacgagttattgcaacgatgggccatttcgataagttgagtattggtgatgctggcatgccagtaccaagttcaaccgaaaaaatcgatttagccgttgataatggtattcctagttttatgcaagtcttgaataacgtcttggaagagcttgaagtacaacgaatctatttggcagaagaaattaaagttcaaaatcctaagatgttgacggccatcaagaagcgcttaccagacaccccaattaccttcattccacatgaagaaatgaagaaggacttggctgactgcaaggcctttgttcggactggtgaaatgacaccttattcaaatattctattggaaagtggcgttactttttaaagtagttggtgattaatggagggattggaatgaatactaccgctttactaattggcttagggccgttacttggttggggactttaccccacgattgcgtcgaaaattggtggtcggcctgttaatcagatcttgggttcaactattggaacgttaatctttgcgctgatttatgcatgggtgcaagggattgcttttccaagcggcatgaatctctggttttcaattctatcagggatcggttgggcaagtgcccaaatcgtgacatttaaagtgtttacgatggttggttcttcacgagcaatgccaattacgacggccttccagctgttgggcgcatcactgtggggcgtcttcgccttaggtgactggcctggggcaatggacaaggtcttgggtggcctagccttagttggaattatcattggtgcctggctaacagtgtggtctgaacataaggatgcaggtaacgcccggaccttacgccaagctgttatctggttagcagttggtgaaatcgggtactgggcttattcggctgcgccccaagcaaccaatattggtggggaggaagccttcgttccccaagcaattgggatggttattgtttcgatcgtatatgccctgttcttagcatcacgaggtgaaaagttagccctcgttgaaggggtgtcatacacgcacatcatctcaggtttcttcttcgcgtttgcggcgttgacttacttaatctctgcgcaaccaaatatgaacggattagcaaccggctttattctttcacaaacctccgttgtattggcaacgttaaccggtatttggttcttaggccaaaagaagactaccaaagaaatgtgggtcacgattggtggactgatactaattattgcggcagcagctgttacggtgacgatttaaaacaaattaatatggctataagactatttaatagagtcgctttgaaggagttatacgcttctttaaagcgactctatttttacggttattgattacaatggtcgattacaaaatttgctttatgatatggcgataatgaaaataattcggcataatatttatagtttatatcagacatctaaatgtttgatgaatcattagtccattaatttaaaaagccaatgaaaaaagagtgcattaataatgtatgcgctttcgtatatatttatctgtgaagaaaagaaatgattaaggagcgattttgatgaataattcatggattaatatttcgggtaaggtatacgttgttactgggggctcatccggtattggtaaagcaattgtaactgaattattgaataacggggcgattgtttataatgctgacctcaatcaaggtgatcagcaaaatgataatttacactttgttgaaaccaatgtcacagatgcggaagcggttaatcggctggtcttaaaggttgttgatgaacaaggaaaaattgacgggcttgtaaataatgctggtatcaatttgccacgtttattggctgacgccaaggatcctcacggtaagtatgaatttgcagaatcggattttgcgaaaatgtttgccgtgaacgtgaaaagcgtcttccttgtatcgcaggcagttacccatcaattcgagaagcaacagtacggtgttattgttaatatgtcctcagaagctggacttgaaggttcacaaggacagagtgtttattcagcaactaagggagcgattaatgggttcactcgttcgtgggctaaagaattaggtgaacataatattcgggtcgttggtgtcgcgccaggtattatggaagctactgggctaagaacacgctcttatgaagaggcgttagcttatacccggcataaaactgttgatgacattcgggcaggctataagagtacgtcaaccacacctcttggtcggagtggcaaactatcagaagttgcggatgcagttaactatttactatcagaacgtgccagttacattaccggggttacgattaacgttgcgggaggcaagagtcgtggttaacctttaaattttagttgggggcatggtgaggcaatggataggcaaagttttgaaatattaaacttttttattaataatgatgcattgacactaagagaattacaatcccatttttctgtttcgagagtcacaattaccaagaatattcgtgcaatcaatgattatttggtgggtattgcaaaaatcaacgttaatcaagccaagttttacctagttatcaataattattctgccatggctaagctacaaactaattttttgaaaaaggatttagatttcaatgatccctcaaagcgacaagcaacgattttaaaagaattgttacagcaaatcacggattacgttattctggatgatttggcagaatcattggctgtgagtcgtggcactatcaataaggatttaaaagcgctcaaacaacagcttgattattaccaagtcagaattgagacaaaaactaatcgtgggattcatttagcggttgaacatgattatatgtatgcagtaattacacgaactttagtcgggaaatactacgaactggaagcaacctgggataaagcgacagatgtcaaattgcttaatcttgttaaaaaacttgatcataataatgatactgtgaccatggttaaaagaaatattgcagttattaattggttacgtaaatataacattcaaatcaatgatcgtattaataactatcatccacttcttagtgatgtaacgatggcgtgcttgcggaatctagttactgagataattggtagctcgttaagcactagcgaatgggagtttatttcatacccattaaacattagaaagctaccgaaggatgataatcagttagttcaagtgggattggtcgaagttgaggatttaatgcagtcggtttttccaatccttaagcaaaaattagatgtgaatttggactttaaacggctgttgatggagttgcgatatcatttattatttctcattaatcgggctatttttgatgtcaagtcagaaggatttatctcggtagacatgttaagtaagtatccagtttcaacggagttagcgcaattaacattatcaaccattgccactaaattgaatattcggattcgttcccaggaggttggttatttaacagtctattttcagatggagcttgaagaatacatggcagcgccaattattcatcgggttgcactagttgagcccattaatactagtatgaaaaagtttatttccgagaaattgaaagaaatgttagatgatgatttgcagattgatgtttttaactcaattagtgaatgggagcagagtccagaaaaatatttactgattttttctaacagttttttaacagataatgaattaattaaccacgcgcctattattcggttgaattctatttttaatcaaggaacgttacgtgaacgtcttcaaatttcgttggttgatgaagctgttaatcaggggcagtgtcgatttgatgtcacgcagtttgatgaacaggagacctacgtcactggagtgaaaaaattaattaatcaagagatacaacatggtcaactgacaccagattttatgcaagcttggcttaatcgagagcaacaatcgagtagtatttttggtgatggggttgcattgccacacgttattgataaatctggactaaatcgaatccttgtaacagtaggagtgtttgaaaaaccggtagtattcgataatcaaaaggtaaacgtggtttttttggtcgcaattccgtataaactagatgcaacattaagcaaaatattagcacaagtatacgatctaattcgcagtatcacagctaacagcaatatttataataacttgaaaaattatgatgaaaatcaaggattaaatcagttgatggaggcgatttaatgttaatttattttggcgtgatcctagtcagtgcgtttctattacaaggtttccttggactaagacaaattaagaatttttctaaaacctttcatcaattacgagtgttagcgccagtagcaattggcaaaaatcctaaaaaattacggtcggggacactaattctattagcgataaaggatgacggcacgatcttagaggctcaaatgatgaagggggttacgatttttgcaaagtttagggaattgcatcaactgcggcagaaaaatattgcggaaattgctgcttcataccagcaattaaaacaattcgataagctaacgcgagtttgtctattggatgcctataagaactatttaaattacaaagcaaatcagctaacgccacaagatttcgatggtagtgtcaaaatttggagcctaccaatgattgaaaagctgaaatctatttattataaaggcttatcaagtttgcgaaaaaaacaagtgaacgtaaaggagcattaatactatgaaagtagtcacagatttggcctcgggctttatggggctgtttcagagtggtggtaaaacattaattggatggatgacatcaattattcctgttgtgctattgctgttagtcttgatgaacgcgattattgcctttgttggtgacaagaagatggccaagttggccagagcttcgtcaaagaatcctgtaacccgttatttaattttaccgtttgtttcggcatttatgctcggtaatcctatggcgcactcaatgggacggttcttgccagaatactataaacctagttggtatgcatcgattgctcaattttgccacactagtaatggggtattcccacatatcaatccttccgagtatttcatttggttagggattgcgcaaggggttcagaagttgggattgaatacaatggatttggcgattcgatatctattagtcggcctagtaatgaactttatcggtggttggattactgactttacaacagcctatgtttgcaaacaacaagggattaccttgtccaagaaagttgaatttaacggctaattgagagagtgaggaacgagatcatggcaaaggaatatcatagtatcaaagttgttaaaggctctggtggctggggcggcccgctaattattacaccaactatcacgaagcataaatttgtttatgtcactggaggtaataaaccagcaattgttgataagattgctaagttgacaggaatggaagctgttgatggctttaagacgtcaattcctgatgaagaaacagcattagcggttgtagactgtggtgggacattaaggtgtggaatttatcccaagaagggtatcaaaacaattaacgtattaccgactggtaagagcggtcccttagcgcaatttatgaatgaagctaattatgtttccaatgtagatgttgatcagattatgttggtaacatctgaggaggagcaattttctgacagtcaaaatgaaagcgctaaccaatttgagaatgtagatgacgatacgaaattcgataatacaaagacactaacagcacaaacaaaaaatcctgggatcttaactaagattgggattggtgctgggcgagtcgtttcgacgtttaatcaggccgcaaaagatgctgttcaaacagttattaatactattattccatttatggcatttgtggcattaattattgggattattaatggctctggaattggtaaggtttttgccagtatcatggagccgttagcaggcaatgtctggggcttgatggttttaggatttatttgctcattaccattcttatctccattgcttgggccaggcgcagttatcggtcaagttatcgggaccttgattggcgttgaaatcgggaaaggtaatattccaccacagtatgcattaccagcattattcgcgattaacacgcaaaatggttgtgactttattccagttggcttaggactagctgaggctgattctaagacggttgaagttggggtgccatcagtgttatatagtcggtttatcaacggcgttccgcgggtctttattgcttggattgcaagttttggattatattcaaaataaatttttagaaggtttgaggtgtattgtatgatgacaaaagagagaattatcttttcaacaaaggtcttagaaataggtgcggaatctgctgattttaaatcgattggcatggcagtattatttggtgatgaagctccagacgcattacggccttcttgctttattatcgaagttgtcccaataagtgagcaaatcacagcaggaatgaaacttgaagtcgacaatcaagtctatcaaattacagcagttggtggcgaagtccagactaaccttggaagattaggccatacggctattagttttacgggtgcaaaggaggctaaattgcctgggacgttatatgttgagcagggcgattatcctgattttaaagtcggtagcgtggtacggattatagctgaataaagttctgatcttaaaatatctgttgtcaggtaatcaagttgaaacttgattattgacgacagatattttagtttgaaatactatgttctttgtgaaagagaaatatgaaagccttaacctagctatgctagtccaagattacataaagtacgctatgttattgtacttttatactgataaggtgttcactaatattatttaatgtcgtatttttaatcgaatcatatgggctaatggcagctactctattcatttctccacttgattaataacttgccccaatgtcagcaaatagcaatacacaagatcatccatattcttaagatttaaaccgttacaacgttcaaacttctcgattcgatagagtagagtattacgatgtaggaataacttgctagctgcttggcggacgttgccctgggtatgataaagcgcgcggattagctgcttattgtcggaatccagggagagactattgcgcaaggcttgcagttcaggttggtgctgattgactaaaaagggtaaaagactgctactaagggtgacaatcgtgtcttgctgattctgtgagaataattgttgttctaaagcgaaggtggttggtaggtcttggctcgacctatgtgtgctaccaatgaataaatgggtattagtataaaaatcattgtcaataagggctaaaagactggctaagtcagcactggtatcggttaatgactctgttagcaaaagatatccagagtcagcggtgataaaagcgcggtgtaagacgtgttcgaaggtgtcagcgatagcgctcaaccattgcgaacggtcggcatgtcgttcggtgaagcgtactctaaattgtagtagttgtaacttttttgcggtcgtctgcggggcggtcgtgtggcggcctgtcaaaaattctgaccatgcatcgccagttgtcgcgtttgatttagtatgggttaataattctagtagtgacaactcgcgattactcaggtttgtagtatcaatacaaatgtatttgccggcatcaatagccacacagaccatatttttagccacagagggtcgaggagaaatcgtggcttgcggataaattgataatagttgttgcgtttccatcaacatgacctccctagaaaaataaatatgactaatattgattagtggatgaccggaccatcagcttgacgccaacaacgatttgatcatcaaaaagatgttcaggattattaatttgatcgagtagtgcttcgacggctttagcgccaattgcagcaaagtcttggacaaccgtagttagtgcgggattatttcgggcagctgcgggtaaattgtcgaatccaaccagtgcaattgaggtatcgctattggaagtaagttcttgaagtcgctgtaacgcgcgtagggccacaacatcgttttctgcaataattgcggtgattctctgtgcttggatataggcttttaattgaacagccgtcgtacaagcctgcaaggcttgcgcccaacgtaaaggcaatgcggcatcgctagtagctagctttagatggttgaagtagcctaaaaaacgatcactgacagtaccagtaaatgtttgccaaaatggcgtctctggtaagaaggcaattcggtggtggccacgactttgtaagtgttcgcaggcaattttaccgccagcgacgttatcacttgtaacgctgggaacggcaagagcagccggttgtttatcaaggacgactagtggcattttttgcgcgtatagccgcattaagattggcagctcggtagctaagttttgtggataatagataatacctgcgtattgagaagctagttcgtctaagttaagctggataaaacgctcgttagccatcaattttaactgccaagtcgtaccggctagcgtcccttgaatgccacttggatagtccccaaaggacgttgtttctgggaatggcagtaccagtaagatttgccgttgagtagtactcttgtgaggcttaacaaaggttcccccaccacgaacgcgataaacgaggtcggcagcggccaattcgttcaatgcccgcttagacgtgatacgactaacaccatgcttgatggcaattgcattttcgcttggtaatcgatcgttaggcgcatactcgccacgtaagattgctagtcgcaattgtttaaataagatctcgtatttagccatctgcccacctccacttggtatagtcaaaccgaccatttttgtggctaattacttcatgatagtttgattttaaccgcttacatggtctattcctagggagaaactatatcaagatgtgcacaaactatacttttttacagaaagtgaccgaatggtaactgggcaaggataatgggttaccacgtaaaaaaggactgctagtaaaacagtccttaaattacactcattgtcaattttgatcttggagcatttggtactgagagtcatagagacgatagtattcgccgtgcattgccattagttgatcatgacgaccggcctcgacgatgcggccatgattgatcacaagtatctgatccgctcgttggatggtggataagcggtgtgcgacgataaaactagttcgtccttttaataattcgttaagtccttcttgtaacaaggtttcagtttttgtgtcaattgcggcagtggcttcatctaaaataagaattcgcggatcggctagcaagacccgagcaaaggcgagtaattgtcgttgccccgctgataagctgctaccatgttcctgaaccgttgtattatagccagcgggcaatgtttgaatgaaagcatctgcgcgagcaattttggcggctgaacgaacttcgtcatccgttgcgtcaagtcggccgtaacgaatattatccattatggtgcccgaaaagatgaatgtttcttgttgcatgacacccatctgttgccgcagtgaatcaagtgtaacttgctgcaaattgatattatcgatggtaatattgccagttgtgacgttgtaaaagcgcgacaatagattaattatcgtcgttttgccagcgccggttggtccaactaaagcgattgtttgtccggcttgggcgtgaaacgagatgtcgtgtaatgtcaacgggctggcttcttcatagcgaaatgagacattgttgaagcggacgtctcccttaatgggcggcaggttaaaggcgtccggggcatcgagaatctgtggcttttcatccatagtttcgaagatacgttccaagtatgcggtggcagtaattaaggaattatagaagttaccgatgttaatcactgggttccaaaaattattgatgtaccctaaaaaggcaattagcgtcccagtactgacaacgacccccagttgctgaataccgataaagtaaattagtgcagttgtaattgttgagatgttttgcacccctggaccgagcgcgtattgaattttgacagcttgcatataggcacgccgattgtcatcagcaaccgcatcaaaggtctgaatcgcgttggcctcctgggcgaaaccttgcgtcactttgattccaacaatgctttcatggatataagcattgagattggactgtttatcgcttagtttgcgaaaggcttgacgctgctttttttgaatcaggtaagcccataaaactagtactggaatcaatgcgagactatcaagggtcaattgccagttaattgcaaacatgaatattaacgtgacgaggactgagataatatcagatatgaggttaactaagccatttgccagtagatcacttagtgtattgatatagttaaccacccggatcagaatcttaccatgcggtcgagaatcaaaataagcaaatggtaactcttgtaaatgggtgaatagatcagtccgcatatcaattagtaaactttgaccaatctcggtgattgcccagatacgatatcgaaaacacaggaatgcgatgactaagctgattagaaatgtgccacttaatgcccagatcaatggaagattacggttaggaatcgcagtgtcgatcgcgattttcatcaaatagggacccaagatgatggcgatgttgccaattaaaatagtgattaacacaaagcacaatcgccacgagtaaggtcgtagatagtggccaagtcgtgcgtagtcgtgccaattaaagcggctggtaagttcttcgtcttcgttgtaggtgtttcgcttggtcacactactcatctcctttcgcatctttaattagtccgagttgccgacgataagtctctgcatagtagccgttctgagcaagtaaagattcatgattgccttgttcgataatctcaccatgacgtagaacaatgatgtgatcagcatggcggagtgaggaaatccgagaggcaatgatgaagactgtcttattttttgtaatcgctttcaatcgttgttgaatggttgcttcagtctccatatcgagagcgctagtcgtatcatctagaatcaaaatacgaggatctttaacaagtgctcgggttagagagatccgttgtttttgaccacctgagagaccaacgcctcgttcaccgacaacggtatcataaccgtcaggcatctgatcgatgaagttattggcatcagcgatagccgccatctcgcggataaatggtattgacgcatcgtgattgccgtaattaatattgtcggtaatggtgtccgagaacaagaaaagatcttgcgttacaatcgtaatttggtttcgtaagtcttgggccgaccactgctgaatatcgcgtccgtcaattaagatacggccgttcgtgggatcataaaaacgagcaatgagattcattaacgttgtttttccagagccagtttcaccaaggattccgagcgtttgtcctggttcgacagtaaaattaatatccaaaagtgcgttgacttgaggtgtatctgggaaagcaaagtcgacgtgctgaaactggacagcgcctcgaataggaaccacttgttgtgatttagtggttatgattgttggttgcgtgttcagcattgaacggattttaatagttgcggctgaaaagcgctgaatatcgttaattaaccagccactcatacgcatcggttggttgagcatccataaaaagccgttaaacgaaaccagttgtcctaggctcatctggtgattaatcacgagaatacttccgagcagtaaaacaatgactgataacaaggatgcaagaaaatctaaagtcggtaggtaccgcctagaaacggcagcggaggccatgttcttttccttgtaatcatgattgagttgctggaacttctcgatttcataatcttcacgggcaaaggcccgcacgatccgattacctgaaatgttttcttcaaccatggcattcaagtgggcgaagctctgacggatgtcaaagaagacagtgtgtgcttcggtactcatgcgtgtcgttaaccaggcgataatgggtgttaggataattagtgcgagcattaattgccagttgagccaacccatgacaatcacggcagttaagaaccataggacacattcggcggtgttataggtaacccagcatagaaagtgtcggattgcatcagtatcaccagttaaccgagccataatatcgccgttagtgacagaattgaagaaggggtaatctaaggattgcaatttcgtgaataaatcatggcgaatgtcatacaatgaattttgaccgacgcgttcccagaggataatgtagcagtaacgcatcacggttctaattaacgtgataccgaccatccctgctaataacggcagaagcaagttgagatgccgttgattgatgaccacgtcaacaatgatgccacccaataatggtactgctactacaccaagtgcattgacgataattaagagactagctagtgtgatttgccagcggctgtgccgggcgtattgccagacccactgataaggattcatgattaacctcccgtagtaaccagctaaagctggctaacttgacaaggctaagtatgatgatattggagggatcattgaatagattattttgactagtttaatgtctttttttgtaaggagggatcacaatgttgcaattaagtgaatttgaaccggaagttctttacgcctttccgtttcgaaatgaacatccaggaacctacgtctatcatcaacatgattttctagagctctcaattatgttggaagggtattcagactacaatgtggaaggacaatggcgtcgagttgttgccggtcaggcactgctgtttaaccctggcattcatcatcaggagacccagcccccgcatacccaaagccttcaactgcacattggctttcggcatatcgcgctacctggtcaggtgcctaaccacttgccctttaaagatgcgttaattagtcttgatgattatcgggcagaattcatggcaaatgcccaacgaattgtagcggaaagtcagcgccccactgcatttgggcacgccttgttaattcaagcgatggtgattgaacagctttgctggttattgcgatccttaccagagaatagtgttagtaacgattataccgaactgcatcaaggtaatgttagtcgagatcagcaggcgttggccaatgctgccacgtattacttggatgtgcattacaatgaagatctgacattaggaacggtggctgcctcccttcatgttagtgcggcgtacttgtcacgaacgtttaaggcaattcaaggcgaaacgccgattagttatttgacacggctaagaatgcaacgtgctaagcaactgctcatgcaagaagcaatcacagtacgccaagttgctcatgcggtcggttatcaagatccgtattattttagcaaggtattcaagcggtactttggcgctgcaccaacgttaatcgagagataaaggtgatcaaatgccaataatacgggaagttggtatagttagcggaacaactttattcaaaaatgtaagcgccaccctgtttactgtactcccattatggtatatttcagtcgcaaaaatagatcttgtcagaccctaaaaaataatgaacttgtaggaggaattttctaatgataacgtggcaagggttgactactgagcaagtacagtcagtacaggcggtttgtgccgcaatcatgccgacaagcgatcttagtgttgaatgccagcatgcgacaactggtattcacattcaacgcaatggtgatcaggcgcgtctcacatatggcagtatggcagagttgatgcatggtgctgcattgttatgtggtcgagcccggaaagcaacgcaatttgatattcgacagcagccaagatttgaagtgctggctgccatgctcgatgttgctcgtaatggcgtaccaacagttgcaatgataaagcaaatcatccggcgactagcaagcatgggttacaatgagttatggctatatttagaggatctgtttgaaatcccagaggcaccatattttggtcgtggtcgtggtcgttatcagcagaccgaattacatgagattgctttgtatggtgatcgttttggtgtgacgatcgttccagctgttcagaccttagcacatctgcataatgcgttaaagtgggatgcgcatgcggcagtcaaagacacggacgatacgttactggtgggagcacctgcaacaaaggatttcctcactaatcttttgcgtgcggcgagtgccccgttcacaactaataagattcacgttgggatggatgaagcctatcagcttggccgtggacgctatttagatcaaaatgggtttacagatcaagaaacacttatcttacaacagttacaattagtcgtatcgttaactcaaaaattaggtttaaaagcttatatgtggagtgacttatggtttacattcgcttcatcaaagcatgaaatgtatgatccggatgtgcattttgaccctgcctttaaagcgagtttaccgccagtcggtcaagtttattgggactattaccatgaagatgaacagacttatcgtgagcgctttacccaacacttcgaacttagtgatgatgtggcgtttgcgggcggaatctggacgtggagtgctttggcacctaatcaaagtaagatgctggcaacgattgacgcgggcttgaaagctgccaaagcgagtggcgtgcagcaagtagttgcgacaatgtggtttgacgacggcgcagaagtaccttttagtgcagcgtggtatggcctacaagcttttgcaacttatcagtattacgaggatgtcacaccggcgatgatcgatacagaatatgccatgatacagggcgaaaacgcgactttttatcgactcttagatcaatttgataactttacgagtaaagttaacgtcgatgctgataatgtgagcaagttgattctttatgaggatctaatgttgcagcgataccggtctaacttagcagttattgatgttgaagctcattatctggacttaatgacgaagcttgatcaggtacacgtccatcaagaaaatcaattgatggtgaccttttacaagcaattggcacggacggttttagtaaaacaacgagctctaaaggtagtggtagcccttgctgattctgatgtaaccaaattacgggctgactcggctcgagcggcggtgacaagttgccagcatgcactggaacaattattacgcgattttcgagcgctttggcagcaacaacggcgtggaaatggctttgaggttatcgatgttcgattaggtggtcaaatcgcgcgctgtgagacggttacttggcgtattgatgaatggctagcaggacgtgatgacttagctgaattgcgagaaccgttattaccaatggataagcgcaataacggattggtcgggcacgggctgtataaagaaattgtgagcgcctgtgaattgtcattttagatagaaccgtaacgacgccgaaaaaatggtgtcgtttttattttggttgataacgataatgggatggatgctaacacaatgctcgacactagcttgatatgctgatgttggtatgctaacaacgtgttaattcgattgttaggttgtttaataaacgttttaatcagagtggcccgttgattctaacaggattagattgttgatttttgtgtcgaaattatacctaattttgatgaaatcttgagtttgtcaatatatcccttaagttagttgattgttgccgtttgagaaagcggttactataacaggtgtaataatgaaaggagggagaaccgatggcacaaaatgccgcagttccaatcgtcaagaagcgcaatttcttccagcgtttatgggacaaccgcgtattcttgctcatggttgctccaggtgcgatattattaattatcttcttctacattcccgtgttggctaacgttgttgcctttcaaaactttcaatactcggatcaaggcttcatctatagtgtgctgcatagtccgtgggttggctttcagaactttgcctttttcttcaaatcggcagatttttggatcgtgttacgtaacacggttgggtacaatttaaccttcttactgttgaactttttctttgccatcttctttggcattgtcatgagtcaaatgcgcaaccaacgacttttgaaagcttatcagacttcaatgctatttccatatttcttatcatgggcaatcttggcctacttcgtatacgccttcttgagttcggataagggtattttgaaccatattattcagtcatttggcgggacgccgattgacttctacaatacgccgtgggtctggccatttatcattatcttcctaggggtttggaaaggaattggatacaacagtattctgtactttgccacggccatgggaattgatccatcgtactatgatgcggcgatgatggatggtgcaaataaatggcaacagattaaaaacgtgacgttaccacacatcctaccagttgcaacgttaatgttgatcttgaatattggggggatcttccgtagcgatttcgggctattctacctaattccgcgttcatcagggacgttgattaatgtgacacagacctttgatacgtatatttaccgcgcgctgacgacgactaatgatattgggatgtcaacggctgctgggctaatgcaatcagttgtcggtgcactgttaatcattgtttgtaattgggtggttcggcgtaaacaaccagaatcagcattattttagggggtgccgtcattgcgtaagaaaaaacatatttcagctgttgagattcgcaagttcggacctggcgccaacctgtttttcaacatcttcctagcaatctttgcactatcgtgtatcttaccgttcttcttcatcattatcttatcgttgacacaagaatcagatattacgacgtatgggtatcaattctggcctaaacattggacctttgcgagctatcagtatctcgctaaaatgggtcatcaagtgttagtctcattaggtgttacgatctttgtaacagttgttgggaccataatgaacagtttgtttagttcgacgtacgcgtatgcaatttctcgtaaggactttgcctatgctagattcttcactattttcgctttgatttctatgctgtttgttccaggtatggtgccaacttacttggttgtgactcaaatgctaggtctacaggataatatctgggcgttaatcttaccgatgagctttggggtgtataacgttttgatcatgcggactttcttcaagacatccattccggaagcaatcattgaatcggcacggatcgatggtggtagtgagttgcggattttccggagtatcgtggtacctctggcaattccagggattgcaacaattagtttattcacgtcactaggttattggaatgattggatgaatgccttgctatacattaacaaggatagcgtcacaccattgcaatatctactcatcaagattcaaaataatattcagtttatgacacaaaatatgcaagccaatggcgcaattgcgggtgccgccaatgttccgagtgaaggtatgcggttcgcaatcgttgttgttgcaactttaccaattgcattaacctacccattcttccagaagtacttcgtcaaaggaatgacgattggtggcgtcaaaggttagtttggtagtgttgcgtatttaattcgttttaactgttcggggtattaataagtcatttcaaaaaacttttccgagggggaagaacagctatgaataaatttgtaaagggtgcggccctagttagtgccgtagcatttggaacagtggcactagctggttgtggtaagtccaatagcgattcagcatccagtaaggcaacaaccgttaatatgtatatgcctggtgataagccgaagaactatgacgcaatgattaaacgggcgaataaagaaattcataagacttacaagaatatcaatttaaagatgaactttatcggctggggcgattatgaacagaagtacaatgttatggttacttctggtagcggttacgatttggcctttgcgcaaaactatacgtcaaatgcacttaagggtgcatacgccgatatgaatagcgaattaaagagtggtggtgtggccaacaaagcgtacaaacaagttgattcagcctactggaaagggctaaaggttaacggtaaaacatatggcttcccagtcaatgccaacatttacgcgcagaatatgctgacattcaacgatgaattcttgaagaagtacaatattagtattaatgatgttgattcatacgcaagcatggagtcagctttagcgaaattccataaagaaaaaccaggagtggcagcctttgcaatcggtcaagggttcaaggcatcaccaaaacacatggacttcccattgggtaatgggctaccatttgccattgactctagtggttcaagtaagaagattgtgaatgtctacgatactagtgaaatgcaaggaatcctgaagactttgcacagctattaccaaaagggttatattcctaaggatgctgcaacgtctagcacacaatataacttacaagataacacttggttcgtacgtcaagaaacccaaggaccattcgattacggcgattccgctttgattacgaatgcgggcggtaagaagatgaagtctaaggccattacagatccttataagtcatctgctcaatcccaagtggctgtatggacaatttccaagacttccaagcataagaaggaggcgatgcaagtcttgaacctgttgaatacggataagaccttgcttaacaacattacttggggtcttgaaggaactcaatggaactttacggacaaggctaagggtaagatcaagataaccaataagtacaagcctaacacattcattggtgcttggatgatgggtaataacaagaacctttatactcaagactcaacgactgaagcgatgattaagaagcgtgatcaatctattaaggatgcgaagacttctgcagcacttggtttcaatcctgatacgagttcattgaagaccgagattacgaacttatcgaacgtaatgagtaagtatcttgatatcttaaatactggtactgccgacccagtcccaacaattaagaagatggacaaagagctcaaagccgctggttacgataaagttcaaaaagaattacagaaacaatacgacgccttcttagctaaacagtaacacttaaatcatttaccacaaagaggtcgggtgctgggcactacgacctctttgtctacatacaaattgggccataattaagactagtagggggtcagtagcatgcaagcacattggtggcaacgcgcaacggtttatcagatttacccacgtagctttcaagatagtaacggggatggaattggtgacatccctgggattatcagtcggctcgattacttggcaacccttggtgtggatgcgctgtggttaagcccggtatacaaaagtccgaatgctgataacggctatgacattgcggattatcaggcgattgacccagcatatggcacgatggccgatatggatcagttgatcgctcaagcggctcagcgtggcataaaaatcgtgatggatttggtcgtgaatcataccagtgatgagcatccgtggtttgtggatgcttgtcagaatccagatagtccgacgcgcgattattatgtatgggcggatgctgttgatgggcatgcacctaataatctgacatctggtttcagcggcggttcagcttgggagctagatgaactaacgggccaatactttttgcacttgttttcaaaaaagcagattgatttgaattggcagaatccagacttacgacgcgcaatttatcgtatgatgaatttctggatcgataagggaatcgaagggtttcggatggatgtcatagatatgattgccaaggagccacgtgcaaaaattttagtgaacgggccgcatctgcatgaatatttacatgaaatgaatcgtcagacttggcggaaccgtgattttttaacagtcggtgaagcctggagtgcaagtccagaagatgcgcgacagtacagtgatgagcagcgcgaagaattaagtatggtcttccaattcggccacttatgggctgatcgccaggttggcggcgaaaagtgggaacagcgaccacttgatgttgcacaactgaaacaagcgctctatgcttgccaaacgacgatggcgactcacgggtggaatagtttattctggagtaaccatgacctgccccgcgccgtttcacgctttggggctacgggtcagtaccgagagctgagtgcgaagatgttagccattgctttacacggactaaaaggcacaccttttgtctatcaaggggaagagattggtatgactgattgcccagttgcaactatcgatcaagttaacgatgttgaagcccggacaatttatcgacaattacgagcacagggtgatgatgctggtaccgccatgcagaaaatcaatatctttaatcgtgataatgcgcggacgcccatgcaatggacggctaagcaacacgcgggatttacaacgggcaaaccatggttggcaatcaatgccaattatccgaggatcaatgttgcggccgcccaagcggaccaccaatcgatatggtggacgtatcagcggctaattagattacgcaaacagtcggcggtgttgcaacagggtgagtttaccgagttatcagcggtaccggcaccaatcgttgcctacactcggacttggcaacaaacccaatggctaatttgcgctaattttgctgatacacttattacggtagatctaccaaagcgagcatctgagttaatcatcagtaactatcaagattatcctgagcaactggggcgggtggtattacgaccgtatgaagcgtttatccttgcattaagctagaagtggaaacgctattatcaatgaatggattttgatactatacagatagattatgaaaaggaggagacagtaatgattggacgcgcagcggataagatttttacacgggtatttattttcttaataatgaccgtctatttttggatttatacagtcgctgggttggttgtactaggaattggaccggcgtttcgaactgtaactgagatgcatatggataagcagtgggattatcggttatatcactttaaggaaggatggcagcgctttaaacgccatttttggcaaatgaacttgcatacttggttgttcttaggggtaggggccgtcttggcttataatttatatttaagcctttcgattcatacactatggataattttcattcaatttattatcgtatttgctttgattcttgattttagcttagcaatttttaccgtgatgttgcggtcgcgctacgatgttgccttcaaagatgccattaaattagcaattgttcagttctttagtaattttacgcagttattgacctttattattggcacgatcgtattgatcgtcatctctttgaagtggccagggatgatccttttcctaagtcctggaatctatatggttggggcagatcgattgtcacgacggtggtatgacaagattgataagatgctaggggcagtttagatgttgctgaaaagtcatgctatgcaggcgagctttgcccacctgattaagttatatacaaccatcatttcggtgatggttgttttggcaacaaccgtctttatcaccgttagtattcgaacttatgatgcggatttggagcaggccgagaatacggccatcgtgcaggttggtcaaatgcttaatcagaatcaacaaattgccgcgcaattcgcgactcaaatgacaagttcatcgagtaatttaccgagtatcgaaaaatattttgattcgtctatcactgattacagcaattatgcgattgataaaagtattagtggcagtccatactttttctggccaactgagtcacggcaattctttactcagcatgatcaagtaactcaactgacactacgattattgagtcaaaataaggtgtttgttgcgacacaagctaatcctggtggcgccttatatccggccaaagacgttaaacaacgttttgcaattaatgctccgttaatcaatcagacatccttagaaacggatggggttctcagtatcagctttgatcagagcgagatcaagcggcagttgtcacaagtgaatgcgacccagcccttgcaagttgtggtacgttcagaggctgatgatgaagtcttttactttgctggtaaacgggtcacgcgacaacagcaacgtgatctgaaccaggcactaacggcgggcaacatgaaaatgttgcgtgattatcatgttaccacgaaacaattatcatccggttatacggtgatgacagtcttgaataggcatctattaagtcgtctgattatcggacatgttctaccgttaattttattagggttgattttgttactagggctaagtacgggcttgtggctgacttttcgtcggtaccagcaccaactgaatacaattgttgatactgttcaaacggtttctgatggtaatctagatgcacgagttccaatgaatctgcgaccgacagacttgcatacacttgccggcggaattaacgctatgttgacggaaattcatcagcatatttatacgatctatcaattacagatcgcccaacaagaggcgaaccggcgagcattacaggcacaaatcaacccgcattttatgtctaatacattagagtatattcgaatggctgcgttagaagcacatcagccagaactcgccaatgtagtgtatagctttgctgcattattgcgaaataacacggatctatcatcacggacgacactgaagcaggaagttagttttattgaaaagtatgtctttttatatcaagttcggtttcctgatcggctagcttaccaatttacggtcgctgacgatgtcgctgcggttgagattcccaaatttagtttgcaaccacttgtcgagaattacttcgtgcacggtgtcaacttctcacgggtggataatgccctaagtttaaaggcttggcgtgaagctggtatcgttcacgttaagatcgtggataatggccgcggcctgtcaccggaagctgttaaagctgtgaatcaaaagttgaagcaaccattagcagctgaacaacagcattcaattggactacagaatgtctactcacggatgcacgatagttttggggacggttttaaaatgacaattaatagtaatgaccaacagggcgttacggtattgctgcagtttgatgatcgtgagggggttaagtgatgcggaaagtgatgttagttgatgatgaatacatgctattacgtgggcttaaattactaattgattgggaatcattggggttggagattgtgaatacggagcaaaatcccagcttagcgttaaagtatttacaagataatgacattgatattttaatttcagatatgaacatgccggagataccgggcccaaaatttgtagcggctgccaagaagattcaaccagcaatggaattgatcgtaatctcaggatattcagattttgactatgtacgtgctggcttgcagcaaaatgctgtaaattatttacgtaagccaattgatactgatgaattgttggcaacactgcgaggtgccttggaccggttacaagcacaacaacagcaacatcagattgcatcgctggcaattcagacacagacacggacattactgacgactgatcgcgagccagagcaactgcaaattatccaggcgctaggaattgagtttgccacaccaacaaccgttcgccttattggggtactaaaccccttaccgcctaaagatttagtgaattacctacgtgtgataaaagcggtcaagggcttttatactgagcgggaagattttattattgtctttcaagggacgactgaccaattaaacatatttatcaatgaagcacctcatcagatcggggtagcacatcggccatttctaattggagctccaattaagaatgtcggacaattgcgaacgcgttatattcaattgcgtcgtgagattgcaagacaatacttttttgaaactgcttcagggctgcgaatgatgctgccagatacgcaagagagcgtttcatcgacgttgccaagttattctgaggtcaaaaaagcactggatggcatcgatttgactggattttcaatatggttaacccaccaatttgacgcaatgaagcaggcaaatgcgtcggacttgttagcacgacagttcgcactagttgtattgctggttctaagtgaccgactgacgaaatttgatgataaagcagccatcattgccgcaatcaatcacgccaaagacgttagtgatcttaaaggtcagttacagtgggttgctgaacttgctactgaacagggtactcaacagttttcaagaaatgtgctggcaatgcgccagattattaaaaagcgatatccagaacaactttcgttagcggcagtagcgagtgaattgcatctcaatgcggtgtatctgggtcaattgttcaagcaggaagttggacgtagttttgcccaatttctcaatgattatcgtgttgatgtcgcggtggatttattacgagattcagatctggatattggtcaaattgctgaggcggttggttatcaaaattctagttatttttataaattattcaaaaaacaaacggggatgtcgcctggtgattaccgaaaggcgggtgtcctgagtagttaatcaactttaacaagttggttttgataagtatacgcgtaaccaattgtagcgattgagtacattaatcttaataagaaatagtgaaggtgaaaagaatgagtagaagattagggagcattgaagcgggcggtactaagtttatcttagcagtagcggatgagacttatcaaatgggcgcaaagaagcgaattccaactttaacccctgaagagacattggcggcttgtattgacttttttaaggctaatccagttgatgccattggattagggtcatttgggccaattggaattaagcacggcactgccgattatggtcatattctagcaacgccaaaaccaggctgggcggggactaatattgtagggattctaacggcagcgctacacgtgccgatttactttacgacggatgttaatgcgtcaatctatggtgaatacattgctggtgaggctcaagccgttgatgcagcggtttatttcacgattggcactggtattggcggtggtgcgattcaggacggcaactttattgggggttactcgcatctggaaatggggcatgcgccggtaatgttgcatccagatgatgattttgttgggagttgcccattccacggtaatcagtgttttgaaggggtagcagctggaccgaccattgaggcacggaccggtgagcgcggggagaaccttcagcgggacaatcctgtatttgattacattgactattacgctgctcaaatggcctttaatgcatatgttaacttgacgccagaaaaaatcatctttggtggttcagtgattaacgacgccgatatggtcaaggttcgccagtactttgatcagctaaacaatggttacgtgcaagtcccaaccgacttaatcgtacacagtcactttgcagataatgcgtccgcaaccgtgggcaactttgcgttagccgcttccttattagattaatatggtaataccaggtgagaaaaaccggtaaggcgtgtgggttcatataagtcggcaccaagttgatatatcaacttggtgttttttttgaattcgacaattaagtgttgttccacttgaaatggtgcttataggaacttttggtaaaattgccgaataaaagcgaactttttgaataacctgcccattcataatgaagacgctttccaatacaattaatagtgtcagaaaggttgggatttatcatggttgaaattaatttagatcatatttataaacgttatccaaatgcagaaactaactcagtgaatgacttcgatcttcatattaaggacaaggaatttattgtctttgttggaccttccggctgtggtaagtcgacaacattacggatgattgccggattggaagatattacgcaaggaacgttagaaattggcggtaaggtgatgaatgatatctcgccgaaagaccgtgacattgcgatggttttccaaaactatgcgttatacccacacatgaccgttgcgggtaatatggcgtttgggttgaagctacgtaagtataaaaaagatgatattgccaagcgagttgaccaagctgctgaaattttaggactaactgaatttttggaccgtaagccagctgatttatctggtgggcaacgacaacgggttgccctaggccgggcgattgtacgggatgcaccgatctttttaatggatgagccattatctaacttggatgccaagttacgggtatcgatgcgggccgaaattgccaagttacatcagcggcttagcacgacgacaatctatgtgacccatgatcaaactgaagcaatgaccatggctgatcgggtggttgtcatgtcagttggtgagattcaacagattggaacaccttcagaaatttatgatcgtccacggaatatgtttgttgctggctttattggctcacctgctatgaacttcttcaatgttcattatcaagatcaggttattgatgaccataagggcgtacaactaacaattcctgaagggatggctaaagttttagataaacgtggttataatggcaaggatatcgtcttcggaattcgaccggaagatattcatactgaagagatcttcattgatacgtggccaaattcgacagttgaagccacaattaacgtgtctgaattattaggtgctactagccagctctatagtcaagttggtaatactgagtttgtggctaatgttgattctcgtgattttcatcaacccggtgcaaaagtgcagatgggctttgatattaacaaagcgcacttcttcgataaagaaacacagaactccattatgttggatgaagaggaagaaacaggtaagtcgcactaaagaagcagtgctcggtattgcgatgctaagatatcccatagatttcaacgctatagcaggcaagtaatatttttgaagcgtgatcaagacaacttgatcacgcttttttgctgttattaggttaatttaacaatagctgtattaatgaaacatagaaaaaatcacctcgataggttgtgctaggtcttaaagtggcactagcaatttataaccaacggaggtgatctttaatagcggattattgttttatttgttcgtaacactagcaggaacaagccctaagcggacgtcaatattggttgcatttagtagctgttgatggctaatcgtggcttggtcgtagtggtggccgttgagcgtcatagtttgcacaaaattattatgatcgtgattgttagtggtagttaattggatatcatgatcggccgtgtgcagtgtaacgtggtcaaaagccggaattccgagcacgtattccgcatcagctggacaaactgggtagaatcctaaacatgcgaagatgaaccagccggccatggagccgttatcttcatctcctgggaacccggtagtggaagcattgaataacttccggagctgctttacgagtacttgagttttttcacggtgccccgtgtaactaaagagatatggtaaatgaaagctaggctggttcgagatagcgacctgaccataatcgacggcagccatttcactcatttcgtgaatgaccatctgatagccaccaacgtgataactagggcgcgtattacagagcgctgtcaactgatcatcgaaccgcttgggacctcccatggcagtcattaagccgttaatatcgtgaaaggcactgtaactattttgccaggcgctgccttccgtgtagtcactcccccagctgtcagggacaaagggttctttgaatcggccatcgctattcttgggacgcaaaaagccagtctgcggatcaagtaagttgagataacgcttggatagttgccagtacttgttggcaatatctgtctgatccaatacgtcagcgacttgtccaatgcaataatcactataggcatagtcttgggtccaattgacactttcaggatacttgtctgcggggatgtagcctaaacgatcgtaatcagcactgccttgccgaccataacggcaatttttaactggttttgaatcgctatcacgcattgcagccagtaaacgaggcatgagctctaatgcgatacctttcttagcactttcagcaataattgagtcaactagattaccgggcatcattccccgctcatctggcgccaaccagcgtggtaagaaaccagtctcattgtagcttgttaagaagcctgccaaaaacttaggtaagagttctggcgctaagatagagaatagggcgtaaacggtttttgaagtatcccagaagccgttattcgtatagagtagacctgatttgatggttttagactttgtatcgtagtggatcggcttgttcttggcgtccaattcataaaaacgttgtgggaataagaacagtcggtacatgcaagtatagaacgtttgaataagctcagggtgatgatcgcgaatagttactcggcttaaatagtcgttccattgtgcagcgcttacattttcaagagccgtcaaatcggcgtcttggagtcgttttaagttaagctgggcttgcgtacgatcaacgtaggatgtggcaaggtgacagttgattagggactggtcactagctaaaagtagtgttagggcatgaccatgaccttcagttgttacaaaccaatgattttggtcgtcgtaatagccagaattagcacggtcaaagcctgaaatcgttaattcaacgtacatagttaggttagggtcttcgccaccatggtagtcgctgacagataatttgacgcccgttggggtaaattcaaaggttacgtgatcggaaaattgcaacatgaggccgtgatgagctagctctaactgctggaagtcatagcgagcaatggccccatacgttgatggtgccaagtcagtttgaacgttaaagtgatcgtcgtaaatcgctagatggtgcgcattgaaggttgcttcgtttggccggtagtttccgacaaagtctggccgcttagttgcatcctgccattggacgcccatgagtaataagtggcaatagtcgccaatccagggactgggttggtgagttaggcgaattccttcaaatcgcggtgtatctggttggaagaaccaggcgccgttagcgccgttagtctgaacggcaaagtaattcatcccaaagggcacgccgctgtatggtaaacagttgccatgagagtgttggggactgttggcggtgccttgacgaatatcaatttggtcaattttcatgatcgttatttctccttagaaattggttggaatggttgagtagagtcacgttgaattaattgaactggcaagcggacagtagttggctgaaccggagtcttcaacagcaaggacactgctttagtccccatccctttaaaatcttgtgcaacggtcgtcaatgaagggtacgtcaggctagcagcttgaatattatcgaagccaacaattgaaagccgctgccagattttaggatcaactttacgtaaagtgttcatcagcttgattgcagtcagatcgttttcaacaacgattgcggtgatctgatggtctgcaagataagtcaaccagtcattagtgctgaattggtttagagtgggtaaatctgcaagcgcagtgaccggcgtaacgtgttgctgattgagggctgtcaaataaccaaagtagcgttcatagacggaacttggcaggactgtgttattacgttgtgcatagaacaagatctgttgatgtccaagttggagtagatgatcagttgcaatttggccgccactgaagttatcagcggtaacgactggcaactcaagcgcaggtaatgtcttatccaagataacgactggaacctgtgccaatttgagttgataaatgcgctcagcttcttgatacaaatcctgtggtaaataaatgactccggcgtaattttcgtggatctccttggctgagagattaaagaaactcgcggaatccatagtaacagcttgatagtgatgttcactagcggctaaactcacgccggaagcatagtcgcctagaccagcatcggttggaaacggcaggacaagtagtagctgcttgttagtctttggctggtcggtcggttgcacgaaactaccgctaccttgtttacggtaaattagcccctgactttctagttcagtgagggctcgcttagaggtgattcgactgacgttgtaagctttagctaactgaagttcggttggtaattgttcattatcggttaaagttccagaggtaatttggctttttaattgattataaatggttaaatagcgcggttctgatttcggcatcgaaagatcctttccggtcaattgagtttagtgtaaatatatcatttttgaacgaaaaagggaagaattagttgtaatttgatatagacaaaccggtattgaatgttataattggtgaaaatgatatatcaaataaggagtgcaataatgacgactaactatgtagatcagcatgtccaacagtttgttgctaaggttaatcagttgagccaaccacttgatcccaaattaggtacagtatttcaaaaaacattcctaaatacgcttgaaactaccatttctgacgatgagcaaggttacgcctttatcttgactggtgacattccagccatgtggcaacgtgattcaacagcacaggtgcggccatacttggcattagcacatgagcaaccagccattgctgacctgatcactagagttgttcagcggcaattctttaatatggcgattgatccctatgctaatgccttcaatgaaacggcgaatggtcacggtcatcaaagtgatcaaactaatatggggccgtggatttgggaacgtaaattcgaaatcgattcgttatgttatccggtgcagttggcatacttgctctataagaataccggcgtcaccgcgcaatttgataataattttgtaaccggtgtcaaaaagctattaacaacatttgaagttgaacaacaccatgcaacatcgccgtatcggtttattcgaacgattgatcgccctgaggacacactggttcgcgatgggcggggcacgccggttgcagatacgggaatgatttggtccggctttcgtcctagcgatgatgcttgtgagtatgggtatctggtgcctgccaatatgtttgcggtcgtaatccttggttatttacagacgatattcagtagcattctggatgatccagaaattgtggcgcgagctcaacgactccagacgactgtgcgtaatggtattgagacgtatggttatacgactaatgctaatggtgagaaagtctacgcatacgaagttgacggcttgggacatgcaaagttaatggatgatggcaatgttcctagcctattgagtgctccttacctggggtattgtgacttattggacttaaattatcaacgaacccgacagacgttattgagcccggaaaacccgtattactacagcggtaaactagcagctggacaaggtagcccccacactccagctcggtatatttggccgattgcaattgcgatggaaggattaaccgccaatagtcacgaacaacaattggccgcgttacaaacgttgattaaaacgacaggaaacactgatttaatgcatgaatcgttcgatgtcgatgacgacacacagtttacccgtgaatggttctcttgggccaatatgatgtattgcgaattattgttaacgacactgggatttaagattgagaggtaggtaaacatgacgaagaagaaggtctttgttatttcacacagccactgggatcgtgaatggtatatgccgtttgaacaacaccatatgcgcttagtgacgctgattgataatttgctggatgtttttaaaaatgactcagatttcgacagttttcatttggacggtcagatgattgcgctggatgattatttagcggtacgaccagaacgtaaacctgaattagcagcggcaatcaaggctggaaaattacgaatcggaccattttatattctgcaagatgattttctgattagtcctgaatccaatgttcgaaacatgattattggccgcgatcaagcgcgtgaatatggtcaagaagttcctttggggtattttcctgatacgtttggtaacatgggacaaacgccacaaatgatgacgctagccaatttgaagacagctgcctttggtcgtggcgtgacgccgactggttttaataatcaggttggagatgcagactatgcatctcaatattctgaaatgtggtggcaaggtccggatggcactcgcattctagggctgctatttgctaattggtatagcaacggcaatgagattccggttgagcgaacggctgctaagaagttttgggatcaaaagctcgcggatgctgaaaaatttgcatcaacggataatttattaatgatgaatggtgtcgatcaccaacctgttcaattggacgtgacggcggcaattaaggtcgcaaatgaactataccctgattatgaatttattcattctaactttactgattacctagcgactctgagcgcagatttgcctaaagatttaagtacaattcatggcgaattaacgagtcaagaaacggatggttggtacaccttagcaaatacggcctccagtcgggtgtacttgaagcaggaaaatacgaagaacgaacggttactagaaaatcaagcggagccactggcagcgatggcttatccggccgcggactatccgcacgatcggttacgctatgcgtggaaattgttattgcaaaatcatccccatgatagtatttgtggttgctctgtcgatgaagttcaccgcgagatgttaacccggtttgcaaaatcacaagaagtcgcacgatttgttgcccacgatgcactgacaacgctgactgctaaaatcaatacgacagattttaatgaacaagcgaaaccgtttgtcgttgttaatacgactggctttaccaagactggtctgacaagaattgttgtagagtgggaccggattgcttttagcgcaacgggtaccattcaggagcaacgccaccaacttgaacagcgattagctgaattaccagaattaatggtagttgatgcccatggtcaaagtgtgccctttcgactaatcgatcaacaagtggccttccattatgatttaccaaaagatcggttccgggacccattccaagcaattgaactcacaatcgagttgaacgtggtcaatatgccagcatttgcttggcggacgttagctttacaaccagccacacaaacgctagtgccaaatgcaacggtcaaggcccaaccacgattaatcagtaatgaatggttgaaaattggtgtggaagatgatggtagtttaacgattacaaatcgggagaccaataagacctaccatcagatgcttgtgtttgaagatacgggtgatatgggtaacgaatatatctatcgtcaaacagctgataagcgcgcctattactcaactgattttccaatggaggtgcgggttgtgcatgcagacgagttgggcagcgagttggaattaatcaattatttggaggttccaacatccgcggatgaacaacttgctaaggagacccatgccattgtggatatcacgcagcgaacagcacagcgatcaactcaaaaagtgccactgacgataacgacgaagattcgtctgaatcctaatagtcggcaaatacaatttgaatcacatgtcaataaccaagcaaaagatcaccgattacgggtgctattcaagacggcactgactgccgaaaaccacgttgctgattcgatctacgagaccgtaacccgtgcgaaccgaccagctaagaactggcaaaacccaactaacccgcaacaccaacaggcctttgcctgtgtctttaacgaggctaatggtgtgacagtcggtaatttgggcttaaacgagtacgagattttgccagcagataatactattgcgctgacgatgttacgttgtgtgggtgaaatgggggattggggctactttgcaaccccagaggcgcaatgccaaggggcgttcacctttaattatagtttggagttaaccgatgggtcggaagcacaacggattgcgagttaccaacgggcgcaaggaatgcaaacgccgtttagtaaccaacagacgtggcaacataccggtaccttggaagcggacgatcaatacttgacgctcgcgacacctgaatttgccgtgacgagcttaaaacgcgcgaacaatagtactggattgacagtacgtggctataatttgagtgatcgtcaagtaccattgaaggtgacaaccagtttatcaaagcaagcagtcaacttctttgaagaagaattaccagaagtgacgacggataccttaatgccaatggagattaaaacgttattattgacggaagcggggcgagcataatggcaccattgggattaatcgatattggtggcacgacgatcaaattcgccgtttggcaagattcgacactaactcggcaccatgcggtcactaccccgacgactaaggcagcgttcatggatctattgcagcgtgaagtggaacaaatgaaggcccaagcggcgattgttggggtcgggatcagttctcctggggcagttaatcaagcgactggtgtaattgagggtgcgagtgcaattccgtacatccataatttcccgattcaagcagaattaacggctcgttttaagttgccagttagcattgaaaatgatgcgaattgtgccgcactggcggaagcatcgacgggtgccggacaaggtgctacgagcctagcatttctagtcattgggaccggcgttggcggtgcattgattttcaatcagcagatctggcacggtgcgcacctgtttggtggtgaatttggttacacaaaaatcaataccacaggaacgctgagcgaattaggaacggtaccgaatgcaattcaccggtatcagcaagcaacgaatcaaactggcaaaatgactggtcagcagttgtaccagttagcagatactggcgatggagtggcgcgtcacgagattgacacaatgtacgcggcgctagcacaaggtatctttaatattcagtatagttttgatccagaaaaaattattctgggtggtggtgtctcaaacaattctgacctgattccgggtattcaacgagctttaaccgctatttatcagcaggtcaagattgccacgttaaagccaacgttagtgacttgtcagtataccgatgaagcgaacttgcggggtgctgcagttgattttgaacaatcccaaaaccgttaggaggcgtgactatggtagagtttccggaaggctttgtctggggggcggcaacgtcggggccccagacagaaggtaactttcataaacagcatcagaatgttttcgattattggttcgcaacggagccggaacaattcgatgccggtgttggaccagatacggcgtcgaacttttataatgattatgatcatgaccttgcacttatggcgcaggcgggggttcaaggtttgcggacatcaatccaatggacacggctaattgatgactttgaaacggcaagcttaaatgctgatggtgtcgccttctataatcacgtgattgattcgatgttggctcaccacattacaccgtatattaatttgcaccactttgacttaccggtggcactctatgataaatatcatggatgggagtccaagcacgtggttgagttatttgttaagtttgctgaacagtgctttaagttatttggggatcgggtcgaccattggtatacattcaatgaacctaaagtcgttgttgatggtcaatatttgtatggctggcattatccgcaggtgattaatggccctaaagcagtacaggtcgcctataacatgaatttggcatcagctaaaacggttgctcggtttcatgaactttgtgtgcgaccggaacaacagattgggattattttgaatttgacgccagcgtatgccgcgtcagatgatccagctgatttggcggctgcggaatttgctgagttgtggtccaataacctattcttagatccagcggtgttaggacattttccagaaaagttggtcgagcgactgacaatggatggggtactatgggatgcgaccccaactgaattggcaattatcgctgctaatcccgttgactgtttgggtgttaattactatcaccccttccgtgttcagcgaccagatatcagcccaaagagtttgcaaccgtggatgcctgatatttacttcaaggaatacgatatgccaggtcgaatgatgaacgttgatcggggctgggaaatttacccacaggcgatgactgatattgcacgcaatattcaaaaaaattatggtaacattccgtggatgatctctgaaaacggtatgggagttgctggtgaagaacggtttctggacaaacaaggcgtcgttcaagatgactaccgcatcgattttatgaaggaacacctaactgccttagcaaaagggattgcggctggctccaattgtcagggctacttcgtttggagtggtattgactgttggtcatggaatcatgcttaccataatcgttacggcttgattcgtaatgatatccatacgcaaactaaaacgttaaagaagtcggcaaagtggtttgcggagcttggggaacggaatgggttttgaattaaataagtgaaactaacgttagtgacgatggtcgctgacgttttttgtttaggactactaacaacattgctttttttgagcattaattcatcaattcaaactagtgatactggatgtttttatgggagaaaaataaacatagtaacatatatatatcagtaaaaggttggcttaaaaaatgatgatctagctttgttttaatacttaccttactataaggtactcacagttcgaactgatgagaagctttatctcgatattttagttgatataacaacgttttgtaatgattaatataccaatttgcgatacgtaatggaaattaatgacgttaaaagtagatggcgtttacagtactataaatgaaaaagcaggtatattaattaaggggtggatcagtatgacgacagattggttgggcttaaaagacaaaatcgttcttgttacgggtggctcgtctggaattggtgatgcgattgtcgaatcattattgaataacggtgcaaaggttgttgatttagatttacattcgagttctaggaagaaccaacactttgattttgttgagtgtgatgtatcgtctgaagaggcagtgacggaggcaatagaccagattttagataagtttggccggattgatgggctggttaataatgctggcataaacttaccaaggttattggttgatgagcagatgccacgtggacaatatgagttatgtacggaagtctttaataagatgtttgctgtaaatgttagaagtactttcttaatgtcacaaacggtaggtcgacagatggtgaagcaacggtcgggaactattgtaaacatgtcatcagaagcaggactagaagggtcccaggggcagagtgtctatgccgcaaccaaaggggcgattaatggcctgactcgttcttggtcgaaagaactaggggtattcaatattagagtggttggggtcgcacctggcattatggatgcaactggattgcggacgccatcctatgaagaggcgttagcgtattcacggcatcaaacagttcaacaattacgatcaggttacacaagcaaaagtactacacctttagggcgaagcggacatttatatgaagttgcagatttggttagctatttactgtctgaacgggcaagttatattactggtatcactgttaatgtggcaggcggtaaatcgcgaggataaaaggaatgaggtagttgaataatcaatatttacgtttgttaaattttttcgttgttaatgattcggttactatggatgatttagttgcatttgcgcatgtatctgaacgaacaatgtgtaagtacattcagcgattaaacgatgatctcgcaggtgtcgcacagattcaagaacaacaacatcgatattatttacaagtaacggactattcacgactaaccaaaatacagatggggcatctaaagaaagaactagattttaatagtacggataaacgggatgcctatattttaaaaacgttgttagagtgtcatgattatgtgacgttggattcgttagctgaacagttaatgataagcaaaacaacccttaatcgcgatctcaaacgactacgggagcagttagtgacgtatcatgcagaaattaaatcaatgacaaacaatggtataaagttagtcgcatcacgtacgtatgaggtgttcgctgttatagatcattttatttatgattattttgaattatcgaagttactgtctaaaaaacaggaagaacagttgaaattaactttgttgaataacggcgctgatactgagacaagccggttaatcttaagaaatataagtgtactaaaatttgcatttccgattggatatcgaattgagcagcctatcactaatttttccaattatttgattgatgatcaacctatggatgatattcgttcaagcgttgtggcctgcttttctactgaaatatctatggacgagctggtatttgttttagcaccattagcatttaagatgaccagcttgttatcacgaaaacgaatgaaagagcaaatcgataacaatagaatgttgtttttaagtatggataaccatagcagtcatcaaatcccgtttgattttgaacatctgtatgaacagatcaagtatcatctgtttttcttaatcaacaggactattcttcatatgccgactgctcagttattgccggaaaatcagctgaccaagtatcctcttgcctatgatttagctcatacaatattggggtttttagaggcacacttggattttaagataacaacagccgaattcgggtatttagtattatatgttgaaatggagcttgaggatcaggacaatattgtgaatcataaatttgaaattgcgattgtcgggcaagtgggctcaagcgttattaaattcattaggcgacaattagttgaaatgtttcaagatgatattacagtcgcggtttttgataatgagtggcaattgaatcaggataacggacgctatctactaatcttctcggatcagccgattgtttaccatgatgagacaactccggttgtgcgtataagtgcagcgttcagaacaaatgagctgagaggaaaactacaagtttcgttagttgaaaaggcgatttcaaacgcaacgtgccagtttgatctttggaaatttaatcatgatacggactatttaacggcagtagaaacaatgatcgatgcacgaatatcggatggacatgttgatagcagatttaaaagtcggtggttagaacgtgaacaacgcgggattagtgttttcgagaaggggatagctattccacacgttgttaatgaaaaggacacaccagaaatattgttacaagtgggcgtctatgatcagccaatcaagtacctggatcgtacggttcagatgattttcttaatcggtacaccaaataatctagatcaagaattgggtcaagtgcttactcaaatatatgacttggtatttttagcaagtaataacgttaatatttatgatcgactgattgattataatgtggatgctaacttattgcagattgcggaggggatataaatgggaccactagtttatttagggctcatgctagtcgctgcatttctattgcaggggttgtttggattcattcaaattaagaatttttctgagaattatcggattatgcggcagcagggtcgtgttttgattggcaaaaaccctaagcgctttcaatcaggaaccttattgttattggcgattgatcaggacggaaatattgaagaagcgcgaattatgaaaggggtaacagtttttgtgaaatttaaaccattgccgataatgataggacgaaatattgcagatatcgccacagattacggaacaatgatgactgttgatcggttgacgcgtgggtgtattttgaacgcttatcgtaattttattaactttagaactaatcagttagcatatgaagatcttgatacaaataccaatatatttgcaatgcctttattaacgcaaatgaaaagtggatggtattggataactagtaagttgcaggaacggactgatatgaggaggagagaaccatgaagataattaccgattttgcttctggatttatgggtttatttcaaactggtggtaaaacatttattagctggatgagctcgattgtaccagtagtactattgttacttgtgctgatgaacacaattattgcctttttaggtgaggaacgaatgaataagctggcaatggcctctgctaaaaatccggtgacaagatacatgatactacccttcttagcagcgtttatgctaggaaatccaatggcatttacaatgggacgatttttaccggaattttataaaccaagtttttatgcatctcaagcacagttttgtcatacgagtaacggtgtttttccgcatattaacccgggtgagctgttcatttggttaggaatcgcacaaggtgtacagaagttaggccttaatacgatggacttggcgattcgttatctattggttggacttattatgaattttgttggtggttgggtcactgacttcacgacggcatatgtttgtcgaactagtggtgtgaaactttcgaaacaggttgatgtcagtttgacaccggataatgcttaggaggattggcgctatgacttggaaaagtattcgtattgaacatggatccggtggttggggtggcccactgactgttacgccaacttcggaacggcacaaattcatttatgtaactggcggcaacaagccggaaattgtcgataaaatcgccgacatgactgggatggaagctgttgatggatttaagacggctatcccagacaatgaaattgcattagcaattatcgattgtgggggtactttacggtgtggcatttatcccaagaagggtattttaaccgttaatgttttgccaactggtaaaagtggtccattagcgaaatatatagttccagaacgatatgtttcagcagtgggggttaaacaaattaagagcaaccaaggtgttaagttcgcagatattgttgatgaagtttcgccagtgaatagcgaatccgatgagaaggtagaaggacagtttgacgataagaaaacgttaacacaacaaatgaataagccaagctttattgcgaggattgggattggtgctggtaaagtggtggcaacattcaatcaagccgctaaagactcggtgcagacagttattaatacaatcattccttttatggcctttgtcgcgttgctcattgggattattcagggatccgggatcggtaaattgtttgcaaaattaatgacacctttggctggaaatatctggggcttgctaatagtgggttttatctgttcattgccgtttttatcaccattattaggtcccggggcagtaattggtcaaattattggaacgttgattggtgtcgaaattggtaagggaaatatagcaccacaatatgcgctaccggccttgtttgcgattaacactcaaaatgcttgtgattttatcccagttggattgggtctggaagaggccgaggcaaaaacggttgaggttggtgttccatcagtattgtattcacgcttcctaaacggtgttccgcgagtgtttgttgcgtggattgctagctttgggttgtattcaaaataagaatggggtgacgcacatatgaagactaatgaagcaattatgtatcagactaatgttaaggaaattggtcaagatgcgcaggatttttcggaaatcaaaatggcgatctttttcggtgatactgcacctgatgcattgcgatcgtcatgttacctgattgaggtgtatccggttaatggggtgattaaaccaggaatgagtctggttgttgataatgaagactttgaaattacagcagtagggcgcgaggtgcaacgcaacttggttaatctagggcatatggcagttagttttactggtaaacagcaagctgaattggcaggaactatgtatgtcgcggataaagaattgcctataattagtattggaagtacgatcacgattaaagaataatccacattcaaggagcgtaataaatatggaactcttattagatacggttaacctagatactattaagaagtatgctgatgttatttccttagctggtgtaacttcgaatccatcaattgtgaaaaaagaacggcccattgatttttataagcatatgcgtgaggttcggcaaattataggcaaggaacgaacactccatgtacaagtggttgggcagactgctgaggcgatgcttgcggatgcacatatgatcctagaggagcttgatgatcaagtttatattaaggtcccgaccgacatgacaggattggcggttattaaacagttgaagaaggaaggtattcatgtgacggccacggcaatctacagtgagttccaaggatatctagcgattgccgcaggtgtggactatttagcaccttactataatcgaatgatcaatatgaatattgattcagattatcgtgggattgaacgtgataatttaggcatcaaacgtaagaatcacgaggctcgtggctttgcccgtaagctccgtcaccgtggtaaaacccgaaaggtcaagggaaccattaaggaacgtcggggacgatttaacgacgtcccttccgttcatgaacgacctgtttcatgtgagaatcgaagctggtttggtcattgggaaagtgataccgttcgcggtaaaaccgggcgttcggccctggtaaccttggtggaccgcaaatctcggtatttattatctcagcgggttcccaaagtaaacgccaagaacgtcacacaagcgatgattgacctcttgcataccgtgacgcccaaacgagttcggacgcttacgccggatcgtggaactgaattcgcaggataccgcgaagttagtcaagagctaagtatcccagtctatttcccagatcctcatgcgcctcagcaacggggaaccaatgagaataccaacggacttatccgtgagtatttccccaaaggaaccgacctagaccaactgactgatcaagatatcgacaagtttgtcagggatttaaatcaccgaccacgtaaggtcttaggctggaagagtccatttgaagttttcttcgggacaaagttgcgcttgatttgacaattcgtcagaatcaatattattgtttaagagattggcattgaaaaacaacctgagattgatcatcaatgtgatgacaataatctcaggttgtttttgaaattggaacagtctatcgattgtgcaattgtttaatcaaatattttttagtcgatagtatttacgtctaaataatgagtaatgcagtcaattatttagatatcggtaatctgaaatataagttaattgtcacgaatacaattgttggtgataataaagtagattttgaaagtgatatactagcgaagacaaaaaaataaatttttattataaataattaactaagtacattacgattgaaagctggacttttaggttgaagccaaaatgttctttatcaattgtttaaaaatcgaaggatttaatgctactaatggttagatcggcaaaccactggcgatcaatatgaaacaatacctcagcattaggcttacggttggtaatatgataataatcgataacggtctccccagtagtgagctctcctttagtctctacttcaacattgcaacgtttacttgtaaactttgaaggatcgatgagccaagcaactgtacaagggtcgtataatgggagacctttaaatccccatcgttgacgaccaaatgaaattccatagaagtccataaggccgctaattgtctgagctactgaattatcaatattatgaattttttcgatttcgttaggaagtagctgtgcttcaaatgcgacatttaacggcgctaaaataatcggtattccggaatctaagacgattttcgcagcttctggatccacctgaatgttgaactcagtggttggtccccagtttccgagtcccatgccaccccctagaataacaatctgcttgatacgagaacgtaactcaggatgcacagataggaataatgcgatatttgtgcaaggccctgtgacaactagagtgactttctgtgggtgatcagtgaggatcttagcaattagctcgatagctggtattccttgagaaaagaaatctggggatggtaaatctgcaccatctaaccctgtaacaccatgcatactaacgccggagattagggaacgcattaaaggcttcgtgtttcctgaagcaactggaatatcttgacgtttcattaaagtaagaagggacatcgcgttgcgtaatgtttgactgtgacgctgatttccagctgaagtcgttacagcgagtaggttaatatcctttgatgcaattgcaatcattaaggctacggcgtcatcatgtcctgggtcacaatctaaaataatatcttccaaaattatcaactccaatttattttatctaaggcagattgcaagaaataacttgaacgaatttaatgacgtaaattaagcaagaagatctcgattggtgtatgccaattaagacatttaagtggccgtgaattcaaataccagttgatttgaaccagttggtgatcacttagttcttcaatggcttggcctttgggaataaagcgccgcaaaactcggttacggttctcattactgcctctttcatgcggtgaataggcatgtgcaaaataaacctgtgtaccagttcgccgttcaattgtctgatagttagcgaactctttaccatgatctacggtaagcgtcttgagcttgtcttgaagttgactagctagttcaagtacggcttgagtcatggactgactgtcgcgaccatggagccgtttaacaattgtcaggcgactcttacgctccacaaaagtagccacagcttgacctttacgtttaccagaaagtacggtatcagcttcaaagtggccgaattcctggcgagtttcgactttatgaggccgctcctcaatggagcggccgtgattgaacgtaccacgcttttctttagcacgatgacgacgaattccatgatcaggcaaatcgggcaactgtatatcaagccatccttgatcaatccagttatagaccgtcttgtaggcaatccccaccacatgggcaacttgttcaggggaccacttctggacttgaatcttttcctcgatcaagtgtttaaggtttttagtgagcgaagacttccgcccccgttgactaacctttcgttcaaagtcagtttgcgctagcccagcctggtactcactatttagccggtgaagttcgttaaagatggtggtcttactaaagcctaagtagttagcgatgtatcgcaaggaacgtccttcattatgaagcgtttcaatgacaacacggttctggaatgataaaatagtggtgctcatcaagttccttctttctaatggattgtgtggtaacaccattaaagaccttgatgggtttttctgtccacttaaatgttcaacttaaattttacaatctgccctaaagaaaagctgaaatcatctcttagtgtaggcgaaattaaaaaagtggttagttcaccataatcaaaaagataattctcagcttctctcactaataattataatataataatcatttgtcgataaatattaacaattaaaagtttatatattccgtgatgcggattatatctcgattaatttaatatacttcacaggtggtgtaataagaactaaaaagcacccaagtctgttgaatcagaagggataatctgatttagaatgacctagatgctaaaaaaatttgtgcatgataaattgcgcttaaagagtgacaattactttaccatcaggattgccgttttcgacatctgactgtcctttacgaataccgtcaagcgtgaaagactccaagtgatcaatcggaacatgtaactgattgttccgaatcattaaggaaatggtggtgaatgcatcactatcgcgatattcacgtcgagggataacttgcctgtaaataacgtctggttttaatgtgcggtccttaggcaaggttgttagtgagacgtatgtgccagtaggcttaatgatttgtattccagcaattgaagcgccaagattagtagcatcgattagaatatctgccatgcttttgaatttggaactgacgcgttcggtatcatacgccccaaattcagaagccccaagatttaaaacagtttctcgagccgactcggcgtccgttccaataacgtataatcctaaagcgtgtgccatttgaacaagcattgacccaacgccaccagaagagcccagaataacgactgtttgcccctgtttaacatgggctatgtggacgagtgtgttatatgcggtaattccagatagagggagtccggcagcctcataagggctataattgcttggacgtgagccaagatgatcaactgaaaccttaaagtattcggcatatgttccaatccccggccgtgctaaaacgtcgtcgccgatactataatcatgaactcctgctcctagcttaacaatgcgaccaacgccatcagttcctaaaattgtcgggaaaagtagcgttacgttattccgaaattgtccatttctgacagcaatatcaaatgcgttaatggcaaaggcagttgttttgaccaatacttctccaggcttaatttttggaatagggatatttagttcttccataacgttggaattaccatattgattaaagccaaatgctttcacaagagattacctcctagcctagctttgttgagattgaatatctattagtgcttgataagcaagatcatgatcttccgtatcggttagaccagatacgattaagctaccgattatcccagtactttcaagtccgattgggaatccaccacctacaattgcatagtcacgtcgactcaatccattattgatgtagaatttgtctggattttcttcataaattgctttttcaaacaaagaactgtgatcaaatttatcgacaacgtttgccttcttgtggatccagagattgttctcgttcgtcgtttgggttccggcgtggaagaaaacgatccgtttatttattttgattaggatgcaaactttatcgaaattctctcgaccgatctttttcaagctaatgactaatttgtcaacgtcatccaagttaaagtgtgtgagcaacgcatttttctcttgtccaataatcttgttctgatcaatcatcaaataacctctttctatcttaattaatctaaaggataagtagtgtcaaccttttgtggcaggccagtttctagtgattttttagctgcaattgcggcccgctgtgccatgattacatcgcgaccctgagcaaccagtggttcatcttccagaattgcacgaacaaaagcgtgcatttcggctaaataagcttcatgatagcgttgtttgaagattggtaatggctttgctaactcctcatgcttattgttgtataactcaacagtgctgctgctgacgttttcagcttttagcatcccctcagagccgaaaacttcgacacgttggtcgtagccgtatactgcacgccgactattatcgattaatccataagtgccgttttcaaactggagaacaagtgcaagagtatcaatatcatcaatatcctttaatgttggatcgatgagggtgccacccttagcgtaaacttcagtaatgttgctgttcatcatataacgagccatatcaaaatcatgcatcgtaaagtcaaacaacaaaccaccaattcgttgaattaaatcatgaggtaaaagatccggatcccgtgaagtaatcttaactacctggggagtgccaatcttccccatacgaacattttcgtaaatattccgaaattgaggatccatccggcgattgaaaccaatttgaagtttaacgccggcttttttgacttctcgtaaaacgtttaagctggcttcttctacaagattcatgcttaatggtttctcacaaaagatattctttcctgctttagcagcggcagttacgatttcttcgtgagtgttggtagaagtgaaaatgaaaacggtgtcaacttttggattgtttaaaatatcgtgataatcgcgagtttgatttgtgataccgatatcatttaagtgacttgaaacgttttcaataaagacatcagcaacttgttcaatttcaatttctggaattgtcatcaaattttttaaatgcatttgtcctgcgcgacctaatccaataatacctgcatgtacttttttcataaataaagaccacctttaatatttttattgattaatacacaagttaattatttatcttcggggttaattcccgtggtatcaccatatttaaattccatttggatcaattcaagtgattttccacgcgtttcaggtgcatatttatatgtgaagataaatgacagaatattgaaaaatacgaagatcaaaaatgtccatgtcattccgactgcactcaatagtattgggaaaaagtagcctacaagaaagtttgcaaaccacaggaaaaaggtcgagacacccattcccagtccacgtaagttttgtggaaatatttcagagagcaagagccaaactaatggagagataaaaccttggaaaaagcccaaaaacatcatggtgcaaagaacgacaagtattggtaacagcgggctctggctaagaaatgcagaaacaccaacgattaagataagtgaagtggtagtgccgataataccagcgattagcatgcttcgtctattcacgcgattcataattgacatgccgataaaagtagcgataaccgacactagaccattacctatatttgcaattagagcggcattatgtgcgaatccggagttcgtcaggattgttgttccgtaatacatcatgatattaatgccaataaattgctgcattacgccaagaccgattccaataaagaccaggcgtcgaatccatggtgttgataggtccttgaaagtggcctgcttaatctcgctttcttgattcaatgtatcctgaatctgggtaatttcttcgttacatgtttcgggatgggagcggatttccctaagagaatcaaaggcattatcaagctgattgaccattactagccaccgcggtgattctggcacaaccatcataccgaagaagagtgcaacagctggaatcatgccaaagccaatcatataacgccaaatattagaaatatggccaaaccaattacctaaaatagcatttacgataaaggctaatagttgtccggtaacaatcattaactcgttttgtgttactagacgtcctcttatttcaggggtggatatttctgatagatatgttggcactataacggaggcaccacccacagctagcccgagtaggacccgggagatgatcataaacagtgcgttcggcgcaagagaacaagctaatgtgcaaacaaagaaaagcaaggctaggtactttaaaagtcgttttcgaccaattcggtctgagaggtgtcctgcgaagactgcaccgaatgcagcaccaagagtgatgccactcgtgactagtccttcattattaggcgagaggtttaattccgcgggggtcgccatatatccgattgcaccgttaatgacaccggtatcaaccccaaataataaaccgccaagtgttgaaataaatgcaatatgattcagattacgcccggcatttcgattgatggtttttaaagctggatctgatagcggtacatgatcagatgaaatacttttttcagcagacatatgagtccctcctaagcgctaataagactaatgataaattaaatggaatcagctaacagtgattttaaagttaataactgaacaagtatcattctgaattcatttgctattatttcactatggattgtgaatgtcaacgcttttgaagaaagcgctttttttgttttgcgagtttttgaaaatgtggttgacaatccctttaatagtgagtattctttaagcgaacacaaaggcaagaacttttggcgattaatctgatttttgaataaatcgaaataatttcacaagagcttgctcacctaaagaatgctaatgtaaaggggcgtcaatatggataaaagcacaaaaatcacaagccaaaatatcacaatcggtattatcggtatgggccgaattggcaatgtgcattataaaaatttaatgcgtattcctaatgttacggtcaagtatatttgtgacttggttgcaaccgaagaatggacaaccaaatataaggctgctgatcacattgttacagattatcatgacgttttagctgattcagaagtagaggctgtattaatttgtgtccccaccgatctacatccacagatcacaatggaggctgccgaagcgggaaaagatattttctgtgagaaacccgttggatttgatgatcacgatattttgaaagcgcttgatacagttaagcgctgcggtgtgaaatttgaagttgggtttaatcgacgatttgataaaaactttcgccgaatcgtagatcatcgtatcaatggagacatcggtgatgaacaaattttaaagattacctcacgtgatcctgagccaccatcgttggactatatcaatcattcaggtggtattttcatggatatgaccattcatgattttgatatggcacggtacattacagatgccgaagttgatcaagtctatgttactgggaacgtattagtagatcctaaaattggaagtgctggtgatattgatactgccattattaatttatctttcaacaatggcatgatgggggttattgataatagccgacaagctgtctatgggtatgatcaacgaatggagctatttggatcgaaaggaatggcacatgccgacaatgtcgttgatagtacaaccacatattccggagaaaaagatgttagtggagataagccgatgtttttcttccttcaacggtatattgacgcgtatagggatgaaatagaatcgttcttagatgctgttcgtgggaatcatgaaattgaatgtacgtttgaggatggtattaaggcgattcgattagctcaggcagctaaaaaatcattagaaactgggcagccagcaactgtagcagatatttaaactttactaggaggttatggatatgagttcaaaagcagaaaaagatattaaatggggaattgcaccaatcggttggcgaaatgatgatatcccttcgattggaaaagacaacaatctacaacaattattgagtgatattgtagtggctggatttcaagggaccgaagtaggcgggttctttccagggccagaaaaattaaattatgaattaaaattgcgtaatcttgagattgctgggcaatggtttagcagctatattattcgagatggtattgaaaaggcgagtgaagcttttgagaagcattgtcagtatttgaaagcgattaacgctccagtagcggtggtttcagagcaaacgtataccatccagcgttcagatacggccaatatttttaaggataaaccatactttacagataaagaatgggatgaagtctgcaaaggcctcaatcattatggtgagattgccgccaaatatgggctgaaggttgcatatcatcatcatatggggactggtattcaaaccaaagaggagacagaccgattgatggcgaatactgatccaaagttagttggattactttatgataccggccatattgcagtatcagatggtgactatatggcattacttaatgcgcatattgaccgagttgtccatgttcactttaaagatgttcggcgatcaaaagaagaagaatgtcgtgcaaaaggactaacattccaagggtccttcttgaatgggatgtttacagttcctggcgatggtgatttggacttcaaacctgtctatgataagttgattgctaataactacaaaggttggattgttgttgaagctgaacaggatccatcaaaagccaatcccttggaaatggcacaaatcgcacatcgatatatcaaacagcatttaattgaaaattagcacagttaaacactgatatctagcatttacttagatgatatttaatcaaaaatgaagaggagattattattatggctgaagcacatgtaactaaagtaggtattgttggtattggatttattggatctgaccatttacatcgactaaccaaaactgtggctaatgtcgatgtcactgctgtgtgtgatatcgtacctggcaaagcacaaaaagcattggaccaacaagggttaactgcaacaacatacgaagattatcatgatcttgttaatgatcctaatgtcgaagtggtcgtatgtacggcgaataatgaggctcattacgaaattgttatggctgcactgaaggctggtaagtttacgttctgtgaaaagcctttagcacttgatgctaaacaatgcatggatattattgattctgaaaagaaacttgggcgtcggatgttgcaagttggttttatgcgtcactacgcaccagaatatgtccagatgaagaaaatgattgatgatggtgtcattggaaagccattgatgatggatcagcgtcactacaatcaaacacaacctgaggaatatgattcatcacgttccattattgaaactgcaatccatgaaattgatatcgaccattggttagttaacgatgattatgccaatatccgtgtcttcagtccaaagcaaacccggcatgttcaaaacgcaaaaattcaagatccacaaattgtaatgattgagactaaatctggcatcaacattatcaatgaagtctttgtccgctgccaatatggttatgatattaaatgcgatgttattggtgaagaaggcgttcttgaattgccaacagttccacaggtggcgacccgcttgaatgcgcaatacagtacggcaattttaacggattggaaagctcgatttgaaagtgcatacgatattgaattccgagattttattaatcatgtatcgcaaaatgaatcaccagtaggtccatctgcttgggatggatacatcgctgctgtgactgcagatgctgccttgaaatcacttgccgaagatggtgctaaacaagacttagacttcccatcaacaccagcattttatacggaaagtgagaaagtctcagagtaactgggtgacattgcttcatgcgaggaggatgaaaaatggtaaccacaagaaagccattacgagctgcaattattggtttaggtcgattgggtgcgcggcatgcccgtcatttggttaataaaattcaaggtgttaagttggtagccgcgtgtgctctagacagtaatcaattggagtgggctaagaatgagcttggtgttgagacaacttataccaattataaagatatgattgatactgagaatattgatgccatcttcattgtggcgccaacaccatttcacccagaaatgacgatttatgccatgaatgctggtctaaatgtcttttgcgaaaaaccattagggcttgacttcaatgaagttgatgagatggcaaaggtcattaaatcacatcctaatcaaatctttcagagtggctttatgcgtcgatatgatgattcatatcggtatgctaagaaaattgttgataacggtgatattggcaaaattatctacatgcgtggatatgggattgatcctatatcaggtatggaaagctttacaaagtttgcaactgaagcggattctggcggtatttttgttgatatgaatatccatgacattgatctaattagatggtttacagggcaagatcctgttcaagcttatggtctaaccagtaatatagctgcgccacaattagctgatatcggtgagtttgaaacaggtgttgctcagttgaaaatgagcgacggggttattgcaacgttaatcgggggcaggcatgctgcacatggaaatcaagttgaacttgaggtaatgggatcgaatggctgggtacgaatcggggagcaccctgatttaaaccgagtaaccgtctttaatgatcagggggttgttcggccgtcactccaaagctttggggagcgatttgacactgcatttactgatgaggttcaggactttgtgaataatgttattgtgggaaagcaacctgaagtaacagtagatgacggtatcaaagcattgaagattgccaaggcttgtcaacagtctgcgaatatagggaaactagttgatattcagctatagaaggatggatgatggcctggttagaaagaaggtaccataatggacgttagcgaaagtacaaacaaaaagagcaactcgcacacaggtttcctctggttggcgacattcatagccgcaatggggtcgttactctttgggtatgacacagggatcgttaatggatctcttgagtttatggcggtaaaaggacagcttgatttaactgcatttcaacaaggaattgtttcttcaggattgactcttggggccgcttttggtgcgattattggcggaccatttgcagacaaaattgggcgaaaaaagattttaactatcttaggtattatcttttcagtcggtgccctaggatgtgcatttgccacaaacattactattttaatcgtatttcggtttgttttaggtttagcggtaggctctgcatcggctaatgtaccagtatatattgccgaaattgcaccaactgaattacgagggaaaatggtaacaactgcgcaagttatgattgtttctggccaatttgttgcttttggtgttaatgctgctctaacgccattgggtgctcaaaatgctgcaatttggcgctggatgttaggattaggaactattcctggcattatcctttggatcggaatgtaccttatcccagaatcaccaagatggttggtttcgcaggggaagatggataaggcattgggtgtgttacggagaattcgttcggctgccagtgtggaatctgaaatgaaggagattcaggataaggataaggccgataaggaactaaatgctgaacaagcaacgtttaaggagctaattagtaaacgctgggttgtacaaattctgattactggtgcaatgttgggtatcattcaacaatttgccggaattaattctattatgtattatggtggtaaaatcattcaagaatctggatttgatacgactgtcgcggcaatattaaatgccggtaatggatttttgtcgattgttggagctgtcttaggaatgttcacgattgattggttaggtagaagaaaattagagtttgcaggcctaacaatttgtggtattacgctggtttttgctggtgttatccatactgttgcgcctaatgctagctgggctggcattacgattgttgttttagtttatctttatattattttcttccagggtacattaggccccgtcacctggctgattaattcagagatttttccacaaagatatcgtggaattggtactggtattacaatctttgtattatggatcggtaattttattgttggtttgttatccccagtattattggaatggaatatgtcgaatacgttttatatttttgctgtgtgctgtgtattaggtattatctttgttgcgttacgagtacctgagacgaaaggcgtaccgctagaagaaattgaaaaatacttccggactaagtatgacaaatgattattttgataaaaacatttagttatcttaaattgactataacatgctaaatatcctgtcatgttatgggttgctgtaattgaccgtcagtgcataaaagctaaaaggacgttgcttggacttgaaccaagtgacgtccttttagctttgaaatgaattttttatactaatccagaaaagcgtctgtatcctttccacaggattggtactgcttaattagcccaagagacttgaaaatagtttcttgataagcaattttagcattccattcaacggtttctagaatgcgggttgcttcatgtaggtcggtacaagtaattaaaacgccatgactgttcagaagaaaaatgttctccaatgcatcatcaccaagtgataataggcttgtatgcacctggtccgctagttcttgagaacaagcttctttatagggcaaaaatttgattttgcctaaagtttgattgacggcagtgatctcagtaacgtttggcatatcttgtccaatagttgcccaaaacattgattcttcggcatgtgaatggtaaacaaccttgatacccggattggattcataggcgccgatatgcatgttaatttcacgagttaggcgacctacaccgtcaatttgttgtccagattccagatctacgacgagaatttgtgccccggataacttaccaaaccaagcttcggacataaaagtgggtgtcatgatcaaatactgatgatcttttttaacatgaactgatccgtaattaatatcccgtggtgcggtaaccttgacactaatattaccaccagcaacattagtgttcttccggttgaacatttctctagcaaccatggctaagtcacaccgttctgcttcgaaaatataggcttcagtcattttaatccgatctccttacttttactgctatggtctaaggtgcgtttcttgagacagttctttttatattgttcacgcttggcgtgacgtttcgtatcaaactcgccaaataagatatgattgcccttgaaataaatcgtctcgcttattatcatgacgacaatacatgcgctgatactgttagtgctcagagcttcaataaaaaggacgacgtcaaggaatagcagaattgaccagaatagttttttcttgaacattgtttttgttatattcatggttgtcaccgagagttgttgtgtttagatgtattactaaaattcaatccatctaaatcgttcagactaactttagtagcgttattggatgcgctagacttcgacgtgttactaaaatccatatcatcgagactgcctgcggatgtggtcgttgtttcagatggcgctgcggttgttgacgaagattgtgcagatcctgctagtacgtagcgctgactaggcaatttgattttattctggtcaatatatagccagatgaatccaagcaaccataaaatggagatgccaattgcccaccatttaccagtaaatgcttttgcaaagaataggcgaaagtctggtccttcaaaggtagaccaagataattgttggccggcctgtactttgacagtacccgttgattttgccagatttgtgataatcggtgcaaagtaagtggcaccataaaggaagattggtgtggtaataataccaagcaccaacatccgcaataagtttgcaccagtgagtaataatgctgcgacgacgaatgagagattaataatacctgcaaatggtagtactgtatttccaggcaacagcattgcaaacacgagcattactggaaccaagatgactactgtgacccataattcatttcgaccggcaagaattggccagtccagtccaataaagacttcgcgaccgttaaagtgtttcttcataaagtcactcattgcatcggcaattggagagagcgcctgcataaatagctttgaaatcattgggaatagggtcatagcagtagctgcttggattgccaagtttagggatttggaaaccgaatagccagcgccgaagcccagcaataccccaatgatggcccccataacagtattatcaccaaagacgccgatctttttttgtaaagcagctgagtcaaatggtcgattcatagcagggatgaagtctagcagcttgttgagtggttgtaaaataactgcaaatagtgtgacaaagtgtggaacggtaacgccaggcatacctgttagatcttcaatatggcgttgccacatatcgccggcctttagttctaaaacaatctgaattcctgcgacgataaatccgtaaaagacattgtgtgtgaaatagagaaccactacataagtaaaaattttgttccagacattccacatatcgacatttaaagttttagtccatttgaatgtgagcataataaagtttatggctaataataatgggaaaaataggaaagctgatttgtatgaccaggtaatggctgccaccccagtccagccagcatcaatagcattgaggctcaagtgaaaaatctttgacatggctttggcagcgggagaaattgaatccatcatataattaacaactagagtcatgccgctaaaggcaactccgagagtcaaggctgccagaacggatttcttgagcttcaatcctgcaatagtggcaatgataaacataataagtggaacaaagacaggaccaccaagattcagcacataattaacgattgtttttaaaacgtccataatctaacacctcctagtgtttatcaacgtttaagcctatgattgcatattcttcagtgcggtaatgatatcgcgataagaagtttctgggctttgtccagtaaatattggtaatccgttaactgaagcgattccgtaacgatcaacgattgtttgaatttcctcgttgggacgggcaatccagacataaacatcgtagtttgcaaggatgtctggtaacttcttaaaatctgttgcttcaacttcaacgcctgtaatatgatgatcttcgaagaaatcggtaatatgtttaacgactaactcgcttgaagcaactccgctcccacatgcaacgataattttagccatagtaatgtactccttttgaattatttgaacttttcagatagataattgaacatttctttagtgtcagttatttgactaaactgggtagtaaagtctttgtcctgaattaatgccatgaatttttgtaaaagaatcagttgatcgtccgactttgtaattccgaggaaaaagaaagtactggcttgttcttcggtgttgtaacccatctgcagcatttgtatcggagctttagttgtcacaacacaaacgaagggactattaatgttttcgggatcggcgtgaggtaatgcgattgagatgtaatcactcacaattccagttggaaattcatcctcacgcttattcagggctgcttcgtacgaagacttgacgtagccacgggtgtttaattttttagcaatctgcttgtataaatcagtgcgactttcggcatccacgtctagaaaaatcaagtcagatttaagcatatcttgataattcataaaaattccttctttactttcgtaagcgcatacattattctgcattttagagcttgttgcgactagtcgttaaaaaaataatttgatttaagtcagtatgctaatatgttagtaatcggtaaaaatatctcaaaaataaatccatattgccaaactaacttccatcaacaatcagtatatgttgacgttacggcgttttgtattcaattcgacgtaacatgaaactcattcaattttttcctgtttaattgttcagattaaggtgaaaaaattcagaattgttcaaatggagggcaatatggtaagtcgagatgatcgtgttttacacatacttaagatattgaacaaacaccccagaattagtgtgaaaagactaatagaactaactggcgaaagcgtttctacaatgcgacgcgatctaattgttttggaacagtcgggaaaagtcaaaaggacatttggaatggtctctttattggaaaataccaatattgaatttgcgtcaccttttcgatatcggacgcatgtcgaagagaaaaaggtaatttgtcgattattagcaagaagggttatcaaagataatcaagcactgttcattgatccgagtacaacgacggcgtatttaccgaattacttatcggagcgacaaaacgtcaaggtgattaccgacaatctgcagtttgcgattgctgctaatcaaatgacaaatttaaatctattcttaactggtggttcgttacggcctaattccaattcattattgggtaatcatacaattcaagatattgcgatgtttagaccgcagttagcaattgtttcttgtagcacgttggataatacgggagcgtatattgcagatatggatcaggcagatgttaagattgcgatgatgaaaagtgctcgtgaaagcattcttgttgcagaccacactaagtttcagtctgttaattctgactatatccggttagccagctttcctgcctggtcaacgattgtgactgatagagcaccgaaagaccagtttttaaaacacatggcggcactcggtgttaaagtcatttacccggggtctaaataaatttagtgaaataataaatatcggccattagtttgtatcactatatagtgaatacaagtaatggccgatatttgcgttatgcttagcgatcagtgctggggagcgtcttataataatttttatacttctgataaaagaatgttttgttcttaattccgacttgttccatgattgtagcgatgggtagtgaggtagatgcaattagcgtgtgggcttgaattagtcgttgccgagttagaacttcactaaaagtttggccaacttcagacttgaagatgttacttaaataatttttattataattatagcgatttgctaattcctccaagcttacggtcttatactcttcggcgattgcttttaggaccttaatggctagcagactagatttattttcttgatgagggccattcaaaggatattcacgaaccaattggaccagtaaaattgataaataggatttaataatgctgttcgaaaaatcacgctttaaataatactcatcgatgatccggtctaaagtttcctggacttcgttattacgctttttggtaaatacgaggtagtcccgcttatggttactatcttcaataacttgactgagcaaaaagtcataaaaaatgttattgcttctacgaaggtcatttaacaggttaatactgatgtttttggttctgaaaagaatgtttattaacaaatcattatcacctaaagccttgattgagtgcgttgatccttcatctaaaagcaataaatcaccggtatttagcgttatcttcttatcatcaacaatttcagttgcatgaccttgtagcatatagttcatttccaaaaaagtatgagtgtgagttggataatctgcatagcgattatgacgactgatataaatgtctttattcttaaaaaaataattacttagtacgcgtccatgtgcctttaaagaaagctcctggttaatggcatagggtggcatgtcttcaacgaaacagtgagacgctttttgcttttcttcaatcaacgttgtttgctttaaagcgttcaaaatacgtgtgttcattcacaatcctccctgtaaatatgatactaatgtaccttttaagagttattgtagcaccttaatggtggcggttacaatgtgcttgtaaataaatgaaaacgcttaccaaaaggagggtatttaaaatgagtagtaaccaaaaagaatcacacggctcaacaattgccgtatcaattactaattttttggattctgggtcaattgttgctggtgcaagtggtttaacactatggactaaagccttgggattatcaagctttcaggttggactactaggtgcattgagtgccaatgcatttggttctgcgattggggctttgattggtggtcacttgtcagataaatatggtcggaaagttatctatacctatgacatgcttgtttatatgctagggacgattattgtggcagcctcagttaattttccaatgttattagccggcttcctgattactgggattgcggtcggcgctggggttcctgcatcgtggacttatatttcagaaacgtcagaatcaactaatcgggcggagaacattggtatttcacaattcgcttggtcgttagggcccgccattatttttgcagccggtgttgccttatcgccactaggtgtcatgggtaatcggatcttattcattttcttaacaattgttgcctttattgcatggcgtcttcaaagtaaattggacgaatcacaagtctgggttgaacagaaacaacacgagcgggcgactggtgagaagccacatccatatcgtgacttattctcaaatgtcattaacttaaagtcattgctatttttaattggtgtttacatgttctggaatctagttgccggtgcaatgggcttctttatgccatacgtttatgaaactgctggtgggttaacaaatctacaggccaacttactgcaagccgtcctttggatctttaccgcagttgccacttatgttggttttgcccgctatggtgatcgtgctaatcaccgaatcttctttgcagttggggctgcaatggccgtcgtttcttgggttgtcctgacatttgccgggatgaactggactagtctttggattttcgttgctgtttggggcatctccgcagggatcggggctcaagcgtggtacgcactatgggcgactgaattattcccaactaagtatcgtgcaggctctcaaggcgtgatgttcttcgtcgtccgtggctcagctggtatttggtcaattatcttcccaactattctgacgacgatgggcttcaaagctgccggaacatttatgattggattattgttagtttcattgattatcggggtcatttggacacctcagactcgcggcaaatcactggaacaaattacaaaggaacgttatggtgacgaatttgacgaaagtgacgccaaagataaacagacaccgattaattcaaatgctactggagatgtgaagtaatgaaatcttatattgccgtagacattggcgcttctagcgggcgtttaatgctcggtcagcaaaagcgtggccagctaacgttaaaggaagtgcatcgtttctccaatggatttgcgatgaaggatggtcatgatcgctgggatgttgatcatttaatccatgaaatctttaaaggccttgaaaaagtcaaaaagatggggataaaggatgttgagttaggaattgatacttgggcagttgattatgtacttgtcggtgaaaacggacataaattggaggatccaattagttatcgtgataagcggacacataatgcgatccaacagttaactagcgacctacccaaagagtacatttacgaaaagactggcattcagttccaagactttaacacgctctatcaattgtataaagagaatcatgatttattggctaagacggacaagattatgatgatgccggattatctcggatatgttttgacgggcaatgcagttactgaaatcacgaatgcctctaccactcagatgttgaacttgcgtgtcggtttatttgataaagatttgttaggcaaagtcaacgtgtctcaagaccaatttccacgactagttgagtccggatcggttctgggaaatgtgagccacaaatggcacactcaatatgatattccggaagttgaagttgtgacggtcgcaacccatgacacggcctcggcggttgttggaacgccaggtgaaggtgatcggtgggcattccttagttcaggaacatggtcactactaggaactgagttaaatgtgccagaaaatggattacaagcatttcatgagaactatacgaacgaatggggcgcatacgggacttaccgattcctaaaaaacattatggggttgtgggttgcccaatgtgttcgtcatgaactaggtgatcagtatagctttggtgaactggctgacttggcgcaacaagtaagaccattccaacaattcattgatatcaacgatgaacgcttcactaatcccgaaaatatgattaaggaactccaggattattgccgtgaaacaaagcagacgataccggaaacaccgggtgaattattccaggcaatctattctaatctgtctttgttctatgccaatgaattgaataaacttgaccgtatcttgggctaccacattgatacactgaacattgttggtggcggaagtaacgttgctctgatgaatcagttaacgagtaccctggctaatatcaaggttgtggcgggtccgagtgaagccactgcagttggaaacattatggttcaaatgattactagtgatgaagtagagaacattggagcgggccggcggttgattgaaacgtcatttgatctaaagcggtacttgccggagaccaataagtatggcgacattttaaaagagtatcaacgatttctaacaaataaatctaaggagatggtttaaatggttcggttaggacaagtgatgtatttacacaaagacgcctacgaagaatatgctaaacggcacgcggaactatggccagagatgaagacggcgcttaagaagtatggtgcaacgaattattcaattttcttaaataaattaactggccaaacctttgcttaccttgaggttccagacgaagcgacttacaacgagatcgctgaaactgatatttgtaaaaagtggtggaaatatatggagccgttgatggatacaaatgaggacaatagtccagtcacgactgatttacaagaagtctttcatttagattaacctgaattacttattgaatacgaggaggaaatactaatggttaaaactgacgaagtcgaaaaagcctatcaagttgcaaaagaacgttacgctgaaattggtgttgatactgaaaaggccatggaagcactaaagaaggtcaagttgtctgttcattgttggcaaggtgatgatattcatggtttcttgaaccctgatcaagaattaactggtgggatcggtgtttcgggtgattacccaggtattgcgcggactccagatcaattaactggtgacttacacgaagcattatcattaattcctgggagtcataaagtcgctttgcatactttgtatgcggttacagataagaaaaaagattttaacgaagttggtccggaagacttcaaatattgggtagattgggctaaacaagaaggtattggcttagatatgaatccaaccttcttctcccatccaatggttaagcataactttacgttagctagtcctgaaaagtcagtacgagactactggattgaagttggtaagaaatcgcgggaaatcgcaaattactttgggcaagaattaggccaacaatcggttaataacttctggattccagatggttttaaagataacccaattgataaacaagcaccacgggaacggttgattgagtccctagatgaagtctttgccaagaagtacgatgaaaagaatacgatcgaagctgtcgaaggtaagctgttcggtacggggattgaatcttatacggttggctcccatctgttctataacaactatgccatcagccggggcaaactctggacgattgatgctgggcactggcacccaacggaagatgtttcggataagttctctgctttcatgccgtttggcaaaggattaatgttgcacgtttcacgtccagttcgttgggacagtgaccatgttgtaatctttgacgaagctttacaacggattactcggtcattggttcgtgataacgagttggaacggactaacatcggtttagacttctttgatgctacgatcaaccgagtatctgcatgggttatcggtgcgcgggcaacgcaaaaggccttattacaagcgatgttagcaccaattgatgatttgaagaaagctgaattaaactacgactttacgaagcggttggcggttactgaagaattgaagtccttcccgtttggcgctgtttgggatgaattctgcttgaagaacaatacaccagtaggaactgattggcttgatgaaattcataactatgaacagaaagtccaattccctcgggacaaaaaagtagttacggaataacgacggttagttacaacaaaaattaacaagaaaaggttggcaatgattatgacagactttattgattcaccatatgtacgtgatatggcacaaacaacggaaaatttatatcgacatggctgggacgaacggaatggcggcaacgtgagtctacgactgactaaagaggaagttgaagcctatgctggtacggataaagttttacgtcagattccaattaaatttgatgccagtgaattagcgggcaagtattacttagttacgggaactggccggtactttaagaatatggtcgaatttccagaacgtgacatgggcttgattcgaatcagcgaagtcggcaacagtgttgatttaatgtggggcttcaatgatggtggtgaaccaactagcgaatttccatcacacttaatgagccacattgctcggttgaagcaagatcctgatcaacgggttatcatgcattgccacccaactaacttggttgcaatgacctttacgattccgttgtcatctaagcggttcagtcggacgctatggaagatgcatccagaatccatcgttgtcttcccagaaggcgtaggcgttatcccatatatgtgcccaggaactaatgaaatcggtgaaaagacggctgctaagatggccgactaccgggtagttgtatggccacaccatggcgtcttcgcagctggtgactctctggatgaaacttacgggttagttgaaacagttgaaaagtcagcattaatctacacgacgattcgtgaacaaggtggagaagtcttgcaatcgttgaccgacaaagatttccgtgacttaatcaagcgttttgacttgaaagccaatgaagacttcttaacaccagatgcagtcggagcaacggttgactaagtttggcctgagaagagggttatcatggcagttaccaagttagtgatgcccaatcatgattggctaaaacgatggttatttctcggattatcactcctaattaattcgattggtcatgcattaaccgttgttatgaacttgggcagtgcagtatggacagcttcagcagtaaatctgtatcatctatggccactaagcttgcgagcgacattgtttacttgtggtgtgctggtggttactatgaatgctatcttgattcaccaaatcatttggcgacgtgtaatcggtaatttgttatttactttaccgttcagtttcttgattcaatggtttactgacttgattcagcggagtgagattgcagaattaccgttggcattacgaattgtcatcgatgtgtttggtgtgctatgtgttgctttagcgacatcaatttatcaacgcgcaaacttagttctgcatccgaacgatgactttatgcagattatacggttccgctatgtgcatggaaatgctacagtggcgcaaatagttcactatataccaccgataattattatgatgattacgtttggcgttagtgggcacttatgggccgtcaatgttggtaccgttatttgcttgttctttcaaggcacgttcattggtttcttcgataaacatatctttcttaatttaaagcattacggattagatacgatgcaacgtaattgatttttaaatgggggtctgaatctcttggcgaggtttggatcttcttttgtcttttataacagaaatttttgcttaatgaggtgtgagtatgcaaggtaaacgaccagatttagatcaacgaattcagaatgcagtgtttgggttacccttagtgagacccgatgaacagcatcgttgtttaggtactttttatgaacgtattgagttgcgaatttcgtttgctgaagcgttaaagtataactgtagtggcgtcttacagcgccttttgaaagaaaacagcaaatatcaattgttaataaatggtcagcttgatatggatatcatggggcaatatattcaatctgcaaaacaaaatggtgtgttatttgcaattagaaacagtcagtattaccgtgcagattcgaatagtgctgcagttattttatgtgctgatcatgctttgaatcgggatacagtagatgcgctagagcgctatccacaattaaataaggacgtatgaaacgaaaatagtagtgtgaggcgaagaatggctagcttctaaacatgcagacattgttggaagtatgcccctgtaaaacatacactaattactaaaattgtttaaaaaacgaatgtatgagatactaattttcaacagcgatggtggttcatcaaggcaagcagactagcgctgttgttgatctacaatgcgtttgaatcgtgattaagtggtaaaaaacatgagtttatgaccacttgaatgtaagcgtttgctatggtaatattcgtttattaattgtgcgtaattaaattgtgcatgaaatgggggctttattatggttatgaaacaaacaaaacaaactaacatactagcaggtgcagcagttattaaagttttagaagcttggggagtagatcatttgtatggtattcctggaggttcaattaattcgattatggacgcattatcagcagaaagggatcgaatccattatattcaagtacggcatgaagaagttggtgcaatggccgccgctgctgatgctaagctaacgggtaaaatcggggtttgcttcggctcagcgggacctggtggcactcatcttatgaatgggttatatgatgcgcgtgaagaccatgtccctgttctagcgcttattggtccatttggcactactgggatgaatatggatacgttccaagaaatgaatgagaatccgatttatgcggacgttgcagattataatgtaacagccgtcaatgctgccacgttgccacatgttattgacgaagcaattcgacgcgcctatgcgcaccaaggtgttgcggttgtgcaaattccagtcgatttaccatggcaacagattccagctgaagattggtatgcttccgctaatagttatcaaacgccgttattaccagaacccgacgttcaagcagtgacgagattgacacagactttactcgcagctgaacggccacttatttactatggcattggagctcgtaaggctggtaaagaactcgaacaattgagtaaaacgttgaaaattccattaatgagtacgtatccagctaaggggattgtcgcagatcgttatccagcctatttgggttctgctaatcgggtggcacaaaaaccggcgaatgaggcacttgcgcaagctgacgttgttttatttgttggtaataattatccgtttgcagaagtttccaaagcgtttaaaaatacgcgttatttcttacaaattgatattgatccagctaagttaggtaaacgacataaaacagatattgcggtacttgctgatgcacaaaagacgctggctgcaattttagcacaggtatctgaacgggagtcgacaccttggtggcaagccaatttagccaatgttaaaaattggcgggcttatctagcttcattagaagataagcaggaagggcctttacaagcatatcaagtgctacgtgcggttaataaaattgcggagcctgatgcaatctattcgattgatgttggtgatatcaatttgaatgcgaatcgacatttgaaattaacgccatccaatcggcacattacttctaacttatttgctacgatgggagttggtattccgggagcaattgctgccaaacttaattatcctgagcggcaggtgtttaatctggctggtgatggtggcgcttcgatgaccatgcaagatttggcgacgcaagttcaataccatttaccagtgattaatgttgttttcaccaactgccaatatggatttatcaaagatgagcaggaagatactaatcagaatgattttattggcgttgaattcaatgatattgattttagtaagattgccgatggcgtgcacatgcaagcttttcgagttaataagattgagcaattacctgatgtttttgaacaagccaaagcaatcgctcagcatgaaccagttctgattgatgcggtgattacaggagatcggccactgcctgctgaaaagcttcgtttagattcggcaacgagttcggcagctgatattgaagcatttaaacaacggtatgaagctcaagatttacaaccactttcaacttatttaaaacaatttggcttagatgatttgcaacatcaaattggacagggtgggttttaaattcagctactatcggtgtcttgaataagtttgattgaattaatggagattatcaaataatcttatgttgcgattagggaaagaagcctaacttatttccttaatcgcttttatgttcatgttagatgtgctaaaataagtaacaatagagatggatatgggaggtgtctagatggctaatacacaattaagtgatgcgacgcatattatggcatatattgcgttgcatactgatgaccagctgaaaagtgagcatattgctagtagtttaaatacggatcctaccatggtcagaagaatgatgagtaagttaagaaaagcaggcttgttaacttcggttcgtggcgttgctagaccaacattagcttgttcgcccaatgatattaccttgaaagatatctatgtagcagtggtggctaagcgtaattttttaaacgttgatcataatacttcggagacgtgtccggtcgggtcggtaattccgcgagtgatggaaaaatactattgtgatattcagaatagtgctgaggcacgtatgtcgcgagtgacgctgcaagatattattgatgacattagcgctgttcaacaacaagcataatttaagataaagacttgacaaggatcaagtttttatttaggatatggttgtgcttaaaaaagtaacaacaaaaagagggtaatggaaatgactaaaattaaagcaggacaagcattggcacaagtgttggttgactggaaaattgatcatatctatggtattacagctgactcgattaataatacggtagatgggttctaccaagagaaagaccacttgaagtatattcaagtacgtcatgaagaagttggtgctttagctgccgcggcagatgctaaattaacggggacgattggtgttagctttggttcagcaggaccaggcgccgttcatctcttgaacggattatacgatgccaagatggatcacgtaccggtgctagctttagttggtcaatcagcaacatccattatgaatacgaacttctttcaagaaatgaatcaagatccaatttttgcagatgtagccgaatttcataaacaagtgacaacggctgaacagattccatacgtggttgatgaagcaattagatcagcatacgcgacccgttcggtttctgttgttattattccagatgatttgtctggtcaagatattgagtttgatggttttaaaacggcttcacttagcggcagtcaacaggtcttaatgccgaaattagatgacgttcagcagacgatagcggctttgaaagctgctcaacaccctgttttatggattggcaagggtgcctataatgcgcgtcaagaagttatcgcagtttctgaaaaatttagtttgccggttttgtcgacggctccagcaactggtattatgccaactgatcatcctaatttcatgggctctcgcggtcgactaggaactaaacccgcctttgaagtctcgcaagcggcagatctagttttgtttgttggtactaactttccatttgcacgttacttgccacaaggaattaagtttattcaagtcaataataatttagcagatttaggcaaacaacatgatgctgatattactgttcttgcagatgcaaaagaatttttccaagcattacttcaatccgaagtgacaattaagccaactaagttcttgaaagctgctcaacgtgataagcaaaactggaaccggtggctcaagacaattgctactgatgatcaaggagggttgacggctgaaggggtgctagaagctattaaagacaatgctactgatgatgccgtctttggtctggatgttgggaataatacggaatgggcaatccgacagttaccattgaataagcaacagacttttacgatgtcggcttggtatggcacgatgggttttggtttgccagcaggtttggccgcccaattgaattatcctaagaagcaggtttggagtatttctggtgatggtggttatgccatggtgatgccagacttactaacggaagttaaatatcatttgccagtcattaacgtggttttagaaaacaaagtattaggctttattcaacatgaaaagttactcgctaatcaggcgccgtatgggattgacttgattggtgctgattgggccaagatggcagacaacatgggtgcgattggttttaaagtgactaaccttaaagagttgaaagcaacgttccagaaagttactcaactacagcagaatggtaatcggctaccaattgtgattgatgcaaaaattaaaaatgttgatccaattgatactagttttgttccagtagatccggaaaactttgatgcagatacgattgctaagtatcgtgaacgatatggtatcgccgaagcggatcaaccggcacttagccaattattaaatgaattataaagggttatgtaaaggagattagtataatgacagttattaatggatatgaacagagtgatcgtgagcaaaagttaacgattttaaatttaccatcattggaagcagctgctaaaaagatcatcccgagcggaggctttggctatattagtggtgggtcagaagacgaatggactttaaagcagaatacaatggcctttaaccatgttcaaattgtgccacgagcattgacggatatggaacagccaagcacacagactcaggcttttggcatagatctcaaaacgcctattatgatggctccagcggccgctcaaggattggcacatgcacggggtgaagctgcgactgctgaagggatggctcaagttggggcacttatggctcagagtacttactcttcaacgtcaattgcagatactgccgcagctggtaaaggtgcgccccaatttttccaattatatatgagcaaagattgggattttaatcagagtttactggatgaagcagtgaaggctggtgctaaggcaatcattttgacagttgatgcaacagttgacggttatcgtgaagctgatattatcaacaatttccagtttccaatcccaatggctaacttgactaagttcagcgaaggggatggtaaagggaaaggtatcatggaaatctatgctgctgcggcgcaaaagattagcccggctgatgttcggcgtattacggaatatacgaatttaccagttattgtgaaggggattcagtcaccagaagatgccttgttagcaatcggggctggtgctcagggtatctatgtttcaaaccatggcggtcggcaactaaatggtggtccagcttcctttgatgttttacacgagattgcgcaagccgttaatgggcgcgtcccaataatttttgatagcggtgttcggcgtggctcccatgtctttaaggcgttagccaatggtgcagatctggtggcacttgctcggccgattatctatggattagcattgggtggtgcgcagggtgtcgcttccgtagtgagtcaccttaatgatgagctgttgatcgatatgcaactagcgggaactaagacgattgaagatgttaaacgtgctaaattacttaggtagtagaagtaatgctgaatataatgtctgaaatgaatttaaaatacctgatataataacactttagcgttggttttggtggaagtaaattctgctgagatcaacgctttttattgtaataggaagatgttctgaacagaaatagctgaggaactaagacactgattgacgaattgaagctatgccggcgttgaagttaggatattgtcttaaaatgcacaaaaagcgtcctaaagcacccagctgagtttttcaagtcttaaaacggttattcagacatacttggcaatagtatactgtacacatgcgcacatgcgcgcataccagttttatttaggaggctgaatgtttcataatctagttatgatgacaaggttgtaatcatgagttttgttgtgagttatttttctcataaattaacttcaaagtttcatagtaattaggatatttagagatcgatttttgattagtaaccatcaatgcatattatactgagctgaacatgaatactagttatttagtttttactgaatagctgactccttaatgtggacttacgccgtcaacaatgagaaaaacaaacacatagattcactgacgaataaataaacctgaattctttgaacgggagactttaatttgagtgttgaaaataattattgtaaattacaacaagcgcatgatcaaaaatgtcgagtctcattacggttttataaaacaaatgggcagatggtcgagacagttggctatgtcactacgattgtaccgaaagcaattgcatttatggcaattactggtcatcggcaccttatccaactcaatagaatcattactgtgagtttacagtcccaagaccgccgttacgtcatgtaatatgttttggtttatgattttacgcgtgtatcatgattgctagtattgatatttaagtggcaatattaacgataactagttggccttaacttgatactgggtgtgctttttgagtcgcagtctcttaaattaaaattggtctggaaagtaacttgttaattcaagttctttatcaagggctattaaatagggaaccttgtagggaaatcaattcattttatgaaattgatttctcttttgtttaaacaaaattattctaattatttctaattgattctataagcactttacttaacgatacataaaaatcgtgatacgattcagttgtagttttaaaggatattatggtcactaagttacacatataaatttttatggaggtgttgtaatatggcaaatttctacggaaatgatccttttttcaacaatgatatggatgatgttttcaatcaattatttcggcgcatggataatcaaaattcggagcgtgcacggtatttagttaatggacaatcgctgacaccggatgagtttgctcaataccgagcaactggtaagctaccccaaaataataaaacaatagaagtatctaaagatggtaaacaggctgttaaaaaaggggggattttagaaaagttagggactaatttgacggaacaggctcgtgatggattactagatccagtgattggacgtgagaatgagattcaagaaactgcagaaattttgagtcgtaggacgaaaaataatccaatcttagttggtgatgctggtgtaggtaaaactgcagtcgtcgaaggtctggcacaagcaattgtggctggtaaagttccagaaacgattcaagataaagaaatctattcgattgatttatcgtctttggaagcaggaactcaatatcgcggttcttttgaagaaaatattaaacagctagtaaaggaagttaaagcagctggtaatattattctattcttcgatgaaattcatcagattatcggcacgggcgccactggtggtgaagatggtggcaaaggattggctgatatcattaaacctgctttgtcacgtggcgagctgactgtaatcggggctacgactcaagatgaatatcgcaatactattttgaaaaatgcggctttggcacggcgattcaatgatgttgtgattaatgaaccgacggccgctgacactttacgtatattacaaggtgttaaaaagctgtacgaaaagcatcatcatgttgtattaccagatgatgttttgaaggcggctgtggattattcaatccaatatataccacaacgcactttgccagataaagctatcgatttgatcgacatgactgcggctcatttagcggctaaaaattcgcaaactgatgttgagacattggatcaacgcgttaaaaaattagaggcagctaaggaggccgccgttaaatcggaggactttacaaaagccgctgatatcaagaagtcgatcgaggaaaccaagcaaaaaattaaaaaaacggatcaaaaagaaaaaatcactgccacgattgatgatgtggcacaatcggttgaacgtttaactggtataccagttgctgatatgggcgctaatgatattgagcacttgaaaaatcttgataagcgtctgaaaagtaaggtaatcggtcaagatgaagcggttgaaatggtagcgaaggcaattcggcgtaaccgtgcgggcttttcagagggtgatcagccaattggaagttttctgtttgtgggcccaactggcgtaggaaagactgaattagctaagcaattagccttagatatgtttggaaataaaaatgcgattattcggctagatatgagtgaatatgctgatcgtacagctgtgtcgaaattaattggtacctcggctggatacgtaggctatgaagataatgctaatactctaactgaacgggttcggcgtaatccatattccattgtattattagatgaaattgaaaaggctgatccacaagtattaacgttactgttacaagtgatggatgatgggcgcttaacggatggacaaggcaatgtcattaatttcaaaaatacgattattatcgctacttctaatgctggctttggtaatgaagcattaagtggtgacaagcaacgagatcagtcattaatggataagttagcaccatttttccgcccagaatttctgaaccgttttaatggaatcgtggaattttcacatctgactaagcaagacttaagtcaaattgtcgatttgatgttggcggatgtacaaaaaacgttagccaaaaaatccatcaaacttgaggtaactaaagcggccaaagattggctgatggaacaaggctatgatgaagcaatgggtgcgcggccattacggcgagtaattgaacaacaaattcgtgacaaggtaacggatttctaccttgaccacttagatgtcaaaaacttgaaggctgatttagtggatgctgagattgtgatatcggcagcttagcttaaatcagtgttcataaataactttatgtaagaggagattgcttgatagatctccttttttcgttgattttcaccatttgatattaatctattgagtaatgtgaattagtgaaattaagtctagtttgacttgtaatctaaggaaaaattaagggggagtatcgatgaaactgatttatattaacgatctttttatatgaaactttagtttcgtatgaataattaaactgatgtatctttaaatgtttatttctagtcttaaaacaatattgaataattaatctatttatgtattcttttcaattaattaatactgttttaaactgttgatacaggtatgtatttgagcattataggagtgggatatggaaaagccagaacaaaaactattgctttataaattaagcgaccggttattcgctgcgattcaaaagaatcttcaactagaaagacggcaggcattactagttaaactaggcattgatactgtattaaatgttattcctaagctgataattactattatcttagcgttgctgctacacgagttggtcccagtgttagtttttatgggtagttttttagttttgcgtggctttgcctatggacgtcacttgaaatcggatttgttatgtacgatattaactatctttgtgtttgtgggtgtgccgtatgtgattggaactggtatttctgaagtatacagattgttattaagtttaatatttgtaataatcataagtatttttgctccagctgatacggtaaagaatcctattacatcgaagtcattgagaaaaaaattaaagcgacgggcaattggattgtcattaattttgagtttgttacaaatagttagtaataattattttggcacaatcattttaattgcgatggcattagccgctttattactaatgccctatgaaaggagggaaaattatgaaagaaaaaatgtataaagtacttagccatctttttcaatacgtaggtactaaacagttggttatgtgctgccatgggatattattcgaaactaaaattcctgatgaattaaaaagcaaggattagtgtagatatatgttaatgattgtcttccaagaattatctatctatttgataattaaatctttgttgagaaatatattttttgtgagactttttgatgttatattcttatccgtctgtatgctgatgagttatatttttttagcaaagttaggaattagtttttcttttttaatgttaatgatgtttatatttttcacttggtggtatgtacgagttctaagcggtgcactatgtataacatttcaagtgttcatatggtcgattatggttgaccatatttgtgatatattaactcgtttaatgaaagttcctaatgggtatgtggtagtgtttgtcatattgagtgtcgtaagcttaatttttcttaatattgtaatggatcgcacgaatttcagtcccacgtttagtaatcagagcttaaatcgcataaccgcactattattaatgataatatacttgtatattatgttgagtgaaggtctggaaaatcagttccaggttatattaagtaatttaattatattgtcagttgtaatggggttagtattggtgatttataacgaatatttaaaaaatgtaagagccaaatatgaagtccaaaagcaaagaatacaaatacaaaatgatactcgctatatgaatgaaatcgaagctcactataatgagttgcgacgtttcagacatgactatcagaatatgttgatttcgatagatgaatatttgaaaactgatgatttagaaggtttacaagaatattatcaaaagaatcttgcaccggtttcaaatcgggtgttaaaagaaaaatataatcttgaagatttgagtcgggtcaaagtgaagtcgattaagagtatcctatttagtaagttgagctatgcacaatcgcaagagattgaagttcattttgatttaaaggaaccattaattgacattactgttaatgaattggatttagacattgcattaggaattatgttggataatgcaattgaagcatcggtaggacatgctgatggagagattatgagtgccatttttatcgaaaaaaatagtacggtgttcttgattcaaaacaatgtttttgaacagttaccacccttatggaagctgaaagaggcaggttattccactaagggcaagaatcgggggattggattgaatagtttaagtaagattgttaatcgcaatgagaacatgatactcgaaaccagagtcttaggagcggtattcttacaacgcttgacggtgaagcgagtatctcagaatgattagtgtctacatttgcgaagatgatccgaaacaattacaacaaatacggcaaatcattactaaggtaatcgtcgatcaacagctagacatgagtatctgtttagcatgccaagatccccacgaattattagacaaggttaatgcacagcagcctcaaaaggcaatctatgtgttagatattgcccttaattcagatattaatggtattcaactagctagccagattcgtgacatgggccggcgcagcaagattatttttatcacgacacacacggagttatctttgatggtgtttcaatatcaagttgaggcattagattttattcttaaggattttccagattccttgtatgagcgatttagcaaggttttacacgtggcacaagatcgttttcaaaccgatgaaaatgaccaagacgactatgttcaaataaaaattggtgagacggtcagatcaattaatgttaaaagcattatattttttgaaagttcaaccagtccccataaaatcgtagtccatttggatgatggtgaattagaatactatggactgttaaaggacgttcctgatttgagtcctaatttctatagatgtcataagtcatatgttgttaacttgaaacgcattaagtcattggacaagcacttgcgacgattaaccatggcaaatggtgaaaaagtgctttgttctgcacaagctaatcgttatctagccaaatggcttgctaaaaagtcataatagttccaaggaagtcgcctgccaaattagtaggcgactttttatgtgctacgtgatgaaaattcagcgttattcgattagaaattgcagtggtatttgtcagcattacgtgtactgggttcgttctttcctaaaccgtttaaaagtgtacttaaaacgattatcctcagattattcgtcttaaaacggtcggtatgtcccttgttcagagcctataataaagatgtgttcacggggtattggattggtcatgacagtaacgaatgcgtttagtttaaaggatgttgtgacaggcagaagttaatgtcgatcaatacgctgtgatgaattttaacgagagaggggcagattaggaatgattaggttatatacacaatcaagctgtcattcttctagagttgcacggcaatggttggaagcacatgggattgagttcaaggagaaaaattttagtgttgattcgcccacggtgcaagatctaaaacgtattttgagtttaaccgaacatggtgtagacgatattatctcagctcgatctaaagactatcctgaaattgcgcctaagttacccgaaatgccattgaatgaggcacttaaattgttgtgtgatcatccgaagttgttacgtcggcctatcatcattagtgatagtaaaattcaagttggctttaatgaagatgatattcgccaatttattccacgaccagttcggcgactaaagttcaatgcattgttgagtcgtctagatggtaatacaggggatcacattattaataaaaggatggtcgagtagtaagctatatctaagattttttgttaattaaagagcgacgggctagacttacacgatatgagtctaacctgtcgctctttagttaataaccatgagacggcatcatcattctttataacaaaaataatatcgcgatggataacatccggtcaaaatattaatcactgataatatcagcaatattcattcccagagcattagccacgcgtgtaccgtagtttttgtcggcctcataaaattgcttgatttcgagttctttgacaccaggcaaagtaacttggcctaacgcatctttgatagtattaattaagcgttcttgctcgggttctgacattaagcgatataggtcgcctgcttgagttgtgtaatcaacttgatagcgataaggctgtgcgcgtgtttcaccacgaacagaatcaggtgaaagtgcggcatccggcacctcttctggcccatgcagtgcattaggctcgtagttgacctcagcaccttgattattaattttcatgtaaccatcacgttcataattatgaactggaacaaccggcttgttcacgggtaaatcttcaaagttggcacctaaccgatatcgctgtgcatctttataggagaataggcgaccttgtagtaatttgtcgggagatggttcgataccaggaacaaaatttgctggcgacatggccgcctcttcaatatcggtaaagttattagtgggattctcatttaaagttagtttgccgactttaattagtggatagtctttgtgggagatgactttagtgacatcaaaaatgtcccatttatagtttagaccttcctcatatggcaagatttggacatacatcgtccatgatgggtaatttttttcttgaattgcatcatataagtcatcttgtaaataatctaaatcttggctcattgctttttcagctgcttgagcagtcatatttttaacgccttggtctgagatgaagtgatacttaacccaaaactgttcgccattctgattcacccatttaaaagtatgggaaccgtaaccattcatggttcgataggacgcaggaagtcctcggtcgcccattaaataagtgacctggtgcaatgattctggagaatgagcccaaaaatcccattgcatattttgcgtacgacggttcgttttaggatcccgtttttgtgaatggatgaagtcaggaaattttaaagggtcgtttacaaaaaagaccggtgtgttgtttccaacgagatcataattgccttgctgagtataaaattttaaggcaaaaccgcgcacgtctcgaacggtgtcaggataacctttttcaccggcaacttgtgagaaccttaagattacgggagttttcttaccgacaccattaaataagtctgccttagtatattcccccatgtcgttttcaagttcaaaaaaaccttttgctccggcccccttagcatgaacgacccgttctggaattcgttcacgatcaaaatgggctagtttttccaaaagattatagtcttgcattaatacgggaccacgagctcctgccgtttgggaatgttcattgttagcccatggttggccggtttccgtcgttaatttttccgtcattttaatcgcccttttcacgtaaattacaagaaagctcttgcacaatttaaacgctaacaccttaacagagtgacttcaatcattatgcacagttaagttaatcgttcatgtggcgtagtttaattttaatcagctatcaagctgtttgatattttctaggccacccggaatcgtcacatgagaaatagtagcgacccatttattaaataatgtgttatatttgtctatcattatcgataattgtaaaatgataattataagaagtaatcatttatgaatcggcttaaatattcgtgtaattctattattgtatttaagcggtttaataagtctaggagggattttatgcattggttatgggttttgatcattggtgctattattggtgcaattgcaggtgctattactaataaaggtaaatcgatggggtggattagtaatattattgccggattggttggatctgcaattggggaagctcttttgggatcatggggaccacaattagccggaatggcaattgttccttcaattattggtggtgtgattgttgttgcgataacctcatttgttctgacacggatggattagtaaggagatgattgcgatgattaaaagcattttaaagttttgtttagctgcaatcttaatcgtaagtggtgttcttattggtgggaccgtacttactgctaagggaattgataacttgggtgataaattacaagataagttacatggataaaaattaattttacaatgagccactgatgggtgtactagttgacctgttagtggcttttagtatgagtaatatcattgagttcaaggaactaaatcaagagcgacaattttaaactaccttcaatcgaataaaagtaatatttacttttattaagaatgagggtatgattaaaatcaaaaaaagaggattggcctatgtctaaacttattgcgaaaaatgtttttcagttgccaaaaatgaatttattagtgctgactacatcggctttcttattggccttagacgttattttatacaaaattgctatcggaccagcgtattttcaattatcttttggctttttgtctatggcttgtattggttatctatatggtcccatttggggtggtctcttggagatgatctccgatatattaagctttactatttttggttccggcgcgtttcagattgcctttttgttaactgcatttttagggggatttattgacggtttgtttttatatcgtaaatcagtcaattggttatccgttgtgatgacgcaaatacttgtaatgatttttgttagtctgatgatggactcatggctaatttcagtactatttggcactaattttaaagtgttattgttgggaagattggcacgcgtcatcattcagataccattacaggtgattgctattttttacttcattaaggcgttagaaaaacgacacgtttttgatagaatgaggcttagataacatcgatggatgctacaaaaagaggttgaacatggtatgaaatgcgctacaatcgttaaacaaataagtctaacttttctattgcacttcaagtctagttcaaccttttttaatattaactggccttattatgactgcggaaaaacaatttgggtatcgatggttgagttggtacccagcaaaataaaagagcggctatgtggtgggcatgataattcccttagcagctaaattgcggacacattctgctaagtagctggcgttgtgttctggatagattggtgttgttaatgcaataggagtgaggtgatcataaggcgggcaaaactgcccacgataatttggatcataccatattttattaggatgatagccgcgaagttgcatttcatccatcactaatacatgaaattgatacaacttgtaaggggaatatttgaaaacataattaacggttgcgtgatttttaccccaaccattgcctctcaatgcggcaagctcacggtgttgacctagtaattgttgtcgtggtaattgatggattaattgttcatgccatagacgcataggccacactcccttatcgaattttaaaattaacaggtgaatattaaaaggaccaactcatcattatgatgccgaatatactgatacttttgaacgggtgatgattgtaaacgacggatagttaaagtgaatattcgcaattattatagcatagcgaattgatcaatagtttagtacaagatcaaaaaaacggccatagcaacaactgatatgatcaaacattccttagaatgcttaccttgaaagttgggttgagtaattaaaaataacattattttatgttgtgttagcagcagttctaaattttgatcacagcggtgtttgatagatgtttgacggtatgcaaataaaattattgttctgataaaaggaatcaatgattaataatcttgagcgtcatttttcgaatcatggcgtttttatattacaatggtcctagaaaaagtaaagttatggaggcgattaaatgagtgatttggatcagacaaacaattatcgatacgtcattgttggtggcggaatggttgctggctatgccatcaagggaattcgacaggaagatccagagggcgcaatcttagttatttcgcaagaggcggatgttccgtatgaacggccggcactgagtaaaaagctatggctagatgatgagtttactgaagagaacattcggattggtgctgaaaattatcctaatgtgacttttaagttcaagacaacggttacggctattaatcggcaagataaggtcattacattgactgatagtgagcaaatcaagtatgaacagctattgctggcaactggcggagagcctcgacaaatccagggacctgctgatccacatgtgctagtctttagacagtggtcagattatcgcaagttacgtaaatttagtggtccgaacaagcgagttgtgatcattggtggtggatatgttggtacagagctcgcatcgtcactgactcaaaatgggactaaagttacgatgatttttccagaaaaagcgctgggcgagggtaaatttcctgagtccattcgggctgagtatgaagcaacgttcaaacgtaatggtgtcacactgatgagtggtcagtttgtccaatcatatcaacgccaaggtgatcatttgactctattgacaaaggatggtacggcgatcgcagccgatacgattattgttgggttaggtgtcacgccgcggattagtttggctgaagatagtagtttggatttagctgatggtggtgtgaaagttaatgagtatctcaatactagtgacccagccatctggtctgctggagatattgcctcttatccagatcacatcttgggtcggcaacggattgagcacgtggaccatgcccgactttctggtgaattagttggtcgtaatatggcaggtgctcacatgagctatcaacataccccatacttctattccatgatttttgatatttcctggcaagcaatcggtaatattgatcctaaattgcaattgatttttgattggcgaacgcatggatcgcttgtctatttcatagatgccggtaagttagttggtgttttagtttggaatgttaaggtgaaccttgatgatgttcgcgcattgcttgcgaacgctccagccacggatgatttggtaggttccattcaagagcaagcgggatagtatctggatgagacatttgtgctattgtgaatatacgtcaggacaaatcgaccatcattaacgatggttcagtaacaaatgaaaagtcagccgtaagttattttgcttacgactggcttttatttttaatgtctaaaattataaggcgctaatgaagcgttgtgcgatttcgagtggccgggtgatggcgcccccgacaacgaccgcgtggcaccctaagtcaaggcaacgtttcatcttctcgggcgtatccaccttaccttcagcgataacagggcgtgatgtggcttggaggacttcctttaagtaggcgaagtcattatcagcaatgttggcaccagtcgtggctggtgtgtagccgtgcatcgtggtcccaataatatcaaaccctaacttatccgctactttgacgttctcgatggtatcagtatcagccatcaagagggtatcagggaattctgttcgcatggtggccacaatctccgccaatttttcaccgttaggacgcggctgacccgtgacatcgcaggcaactacggcacagcccgtagcagcaacggctcgcatctctttgattgttggcgtgatgtaaacaggtgagtcgggatagtcgactttgcttaaaccaatgagcggtagatcaacttcgtcttgaatggcctgaatatcaacaacggaattagcgcgaatacccgcggccccagctcccttagcggcaagggccattcgtgacataataaatgaactatgcagtggttcattaggtaacgcctgacacgagataattaatgatcccttaactgtatttaagaatgtatttttcataaaaaagaccgctttctactagtataaattagattagttcttgaagtatttttcgtaaattgccgtagctcctgcttccatttcaggggttggatggctcattggtttcttaacgtaaccggcatcaacacccatatgtttcatgaccaatttaagcgttggataaatgtcgttggcaattagatcagtaatcatatcgttactgatgttttgcagttgacgtgctttgtcaatatcgccagcttcaaaagcgtccatttcctcacgaacacgtggtgcatttaagttatacgttgagccgatgcaaccgtcgacattcaatgcaagggcaggcaaaagcatctcgtcaaatccagataagatgagtttgtctggaaaggcattgcgtacccgttcaagtaagtaaaagtctgcgttggtgtacttgattccgatgatctttggattttcaaagagttccgcaaattgatcggttgttaaggcaacaccagttaaagcagggatggaatagattaataatttgttgtcaacatctttaaggatttcgttgtagtagtctttgatttgttcaaaagtaaagttgtaatagaaaggcgttacggctgataatttcggatagccaagatcagtcgcaaacttagcgagttccttagcttcttttagatttagtgagccaacttgggcaactaagtcaatcgcaccgtttgcttcatcatagacggtctccatgacttgtttcttttcgtcagtattcagcatgaaggcttcaccagtactaccacaaacatacaagccatcaaccttattgacgtcaatgttgtagcgaacgagagcacggatgccatctaaattaatattaccgtctttgtcgaaggctgtcatttgtgctgcatataatagttttttactcataagtataaaactccttaaaatttattttttgatggatttgtaataatcatctcaaaattcaaccgcttacaggaaatactatagcttctaataaaaattattgcaacacgtttttttggtaattattatcattatataaagaaaacgcttacgcaatcgttgctttcctgatattaaatttcttttttagttgataaaaaaataattattgtggtattgttaggccgttcatcttaacgattcgaccaaataataatgcaaggatgataattatgacaacacaatatttagtatttgatatcgggggaacaaccattaagtacggtctcattgacgaagcattacatctaagtcatgaaggcaagtgcctgactgagcataatcatgatggcctgatcttaaagcaactacagcgtgtaaccagggactaccaagcagagtattcgttagctgggattggcgttagtacagcgggaattgtgggcgcagatggtgcgattcaatacgcagggccaacgatctcagattatcagggaacaccaattaaagccgctctaatggcgcaaactggtctaccggtatttgttgttaacgatgtcgatgcggctttgctaggcgaacaattagcaggtggtgccaagggcgcaacttctgcatattgtgtggcactgggtacggggattggcggtgcgtatgtcgaagatggtcggcttatgacgggtgcccatgcgacagccaattcgattggctatacattgtatgacccccttaccaagacaaattatgaacagcgagcatcaacattaacgcttgagtatcaattagcaaaatatcagatgagtgttaaggatgcgtttgaagaagctaagcgtggtacggtcccatatgtcgccatcattaatgattgggcagcagaagttgcgacgggattagcatcaatcctattattgtttgatcccgacattctcttgatcggtggtgcagtatcattacaggggcaatatttggttgatttactgaataatgcgttgaagccgttattaccgccagacttaattaaaacaaaaattaccacggctgaattagccgataaagcccagttatatggggcgatggcagggctgttgatacgataattatttttaattaaaaagaaagcgtttacaattatcgtattatgtgataagttgataacgtaataatcattcgaacagttcaaccgctactaaaaaatagtgcaagcagtgcctactgagtgttaaagcccagttttctaagcatgtttgcaagattttaagtagcggttttttattttgaaatcagtgaagggtggactaaatcatgaagatcggaattaacaccgcaatttatgagtcacaagttcaggcaggagccactcaactggagtgcttaaaaacattagtaactcgttttgatgttagtgcagttgaagttcgcggtgaattcttcaaacccgagacgcgatcggcggaactgttagcaatcagtcagctttgtgaggaacaacactgggatctctattattcggttccagaggaactgtttagcagtgatggctataacgcaagtctagtgacaaatctagaactggcaaccaaatatcatatcaaatcattgaagtatagctttggtgtgcaaccaacattgcaagcacatgacttggaagcgctaactcagctgttagcaactacctccatacaagttacgatcgagaaccaacctaatgcgaatggtgatttggcgacatttgagtcagatgttgcttgggttaagtcacaaaagttgacattagggtacactttcgattccggaaactggtattggattgatcaacagcctgaaccagcctttgcagcattgaagtcagcaatcaccgtatttcatttgaaggatatcaaggatcaaacaacggtgatgttgggacaaggggcaacggattggcacagtctattaggtcagttgtcacccgaaatcccagtatttctggaatataatattgcagctgcagatttatcgggacagattgatttggttaaacaagcattaagttagcgaggttcaataatatgaactatcttttgcaattagttttaatcttattactgacaaagttaggtgcgcatattgcggctacctttaacttgccaagtgtgattggggaactattagtcggaattttagcgggacccgcagtctttcacatcttaacgtatagtacttttattcagtactttgccgaaatcggggtcattattttaatgtttattgctggtctagagggcgatttgaaattgctttttcgctactggaagccagctttaactgttgcgacattaggcgtcatctttccaacggcatcggccgtcctactttgtgtgggaatgttcgatttctcactgacgacttcaatttttctcgggcttattttgagtgcaacttctgtaagcattaccgttcaagtattgaaagaaatggattatttaaatacacgtgaaggtgcaattattctaggcgcagccgtagcggacgacattatctgtgtggtgctattgggaatcagtacaagcctgtttggcactgctagtgcgcacaaccaatcgcttgtggcaatggttttgccgaaagtactgttcttcgtcgttgtaatcgcacttgctaagtggtttgtcccactctttctgagaggattcaataaggttaatgcatctgagaatattacgacagcggcgatggtgctctgttttggtttttcgttcttagccgttaagttaggaatgagcgatgtcttgggtgcatatattgcggggttagcgatttcagaaacacgctttaaggcgcaacttgttgctaaggttgaaccaattgggtatgccgtctttattccagcattctttgtcagcattggtcttgaaattacctttaagggaatgcaaaacgatctagtttttatcggattgttactagtgcttgcgattttaggcaagcaaattggtggtgccattggcggtaaattgtttggattgacctggaatgaggccaatattgtgggcgccggaatggtttcaagaggtgagatggcactggttgtcgcgaatgtcgctgtctcggcgggcttaatcgatcataatcactatacggcaatgattgtggtgactgttatggcgacacttattgcgccatcaatgcttaaaacatttattcaacatggtaaacgagctgtatcacatattagtttaaataaaacaagcgaggcgaaatcatgagtaaagttggatttggagttctgaattgggttgtcttaggagcatacttattggcaatgctaggtgtcggagcttattttaccagaaaagctagtaaaaacacggattcatttttcaaagcagaagggcatattcctgcttgggcggcggggttcagtatttacgcaactactttaagcgcaattacctttatgtcaactccagaacaagcatttttgagtgactgggcatacgctatcggaagtttttcgattctaattattattccaattttagttaaattctacattccatttttccgcaaattgaaagtaacgacagcttatgaatacttggaagaacggtttagcccagtcatgcgggccattagtagtttgctgttcgtactttatcatatcagccgggtggccattgtcatctatttaccgattattgctattacatcggtttcaaacatcaatccaattctaattgcctgtgttgtcggtggcctttgcattctctatacattcttaggggggattgaaggagttatttggagcgatgttattcaaggattcttgcttctaggtagtgctctgttaatttgtgttttaggaatcttttatatcaagggtggtttcggtacggtggttaacgatgtcgttaccaatcataagtttatctctggtaacgactttaatattggcgatctatctaagtttgtgccgttgatcttagctggtcaaatctttaatagtttgtatcaatatactggtagtcaagatgttgtacaacgttatcagacgacagctacgattaaagatactaataaatctatgtacactaatggctggttagcattgattaccattccattattttttggaatgggtacgattctttacagtttctatcaacacacagctgccttgccagcaggattcaatacgagtgcggtggtaccatattttgtcattacccaaatgccagctggggttgcaggattagtgattgctggaatctttgcggccgcgcaatcaacgattgcttctagtctcaacgcgatctcctcgtgtgtaattacagactttaaacaacgtttctttaacgataagttcaaaaatagtaatgatgttaccttggctcggggaatcattatcattgcaggcgtgttaggattagccgttgcgatttatctgttgatgggtaacgcttcacagatttggaacttattcttgtcggtcactggtatctttggtgtgccaattgctggaatcttcgctgttgggatctttacgaagcgtgctaatacggttggggtgttaaccggactagtgttaagtgtcggcttgtccttctgggtacaatcattaaacatctcttcattattggttgcttgcgttgccttcatttcagcttttgtcttgagctacgttgttagcctgctcttcccaggtggtaatcatgatgtgactggattgactgtttcaacaattaatgaaacatacgtgaagaagaattaaaatgtccgacgatcttgtattaatatcgcttggttattagtctaacccatgatgtttaggacaagacgtagacgtaaatctgaaatctcgattgtcttcacatgaggatagtcgagattttgtgctcaatctgtttcaaggcaagttattgacacagattttaaggaggttatggaaatggagatacgcacactagctttaaaaacgcccgaaggacagccatttacgatgtggatctatcaacatgatcaattcacgctatttccggatgatcgactgtggccattagcgttgatttttcctggcggtggctttgcgggctactctgagcgggaagttgaagctgtagcacttaaatttattgcaaagggttaccaggcggccgtagtgaagtataatcttacgtcggatggcccgttttatccaacagctgccacgattggattagcggcattaagctacgttaaacggcatgcgcaggagttgaatgctgattctgatcatgtttttgtcagtggcttttcggcggggggacatttggtagccgtgatgacagcgcttggcgctcaatcagaattcttaaataatcatggctttgaagagacaaagctagtaccatttgcgcaaattttaagctatccggtgattgatctgacaatgggttttccaactagtcagcatgagatgatggctgtgactacggatgaatcttactggcatgcgcaagagttagtcacgagtcaaacaccgccgactttcatttgggcaacgcggactgatgagcttgttccagttgtgaatagtctggtctatttagcagcgctaggtgagcataatgttccatttgagagccatatctatgcagccggtgtccacggattggcatttggtgatttagctgattctcgctatcatcaccctgaagatgtggtcccacgggttcaaaactggtttccaatggcattgggctggttacgtacattatatgctagcaagaatagtactgaaatttaggggggtgtgaaaatgagatatgagcaattgagattaatgacgccgcaacattttgaatttaaattaacctgctattggaaagaccaacttaaaatggattatgatcctcggagatggccaatccttctaatttttccgggcagtggatttattcaaatgacagagcgtgaagcagaaccgattgctttggcttttagtgcacagggctatcagacaatggtagtggaatacaatctattggatcgcgggccagtttatcccaacgcaattgatgtcggtttgactgccttaaagtatgctaaaactcaaggaccaccacattatggtgatgcgaataagacgattttgatgggcttctcggcgggcagtcacgtcgcagcattaactaacgcgatggggaataacactgagtacctcaaaactcacggctttggtgatagcccattgacgtcacgcttgcaggtcttaggttacccggttatcgacttggcggcaggttttccgaaaagtcgagaagaggcctttaaaattagtccagatgaacaatattgggctagtcagaacctagttactgatcagacaccgccaacgtttttatggaatacttgtgcggatgcggtagtgccaacaatgaatagtttattgtacgcagaagcactagctaggcatcatgtcgagtatgatattcatacatttacacatggaaaacacggtctgtgcttgagtacagttgaaactagtcgatataattacccagaagatattgagccacgtgcggcgaactgggttccgttagtgctaagttggttgagtgaaatgttagatttgacgcaagtggactttaaataggagtgacgaatgcaagataatgaggaagtattgggtactcgtttgcaaaatggaatgtttggtgtaccggatctacatccagatgaacaacaccgttatttagggaccttttacgaacgagttgaacttcaaatttcatttaagcaggctctgaggtatgactttacgtcagtactagtgccggtattgcggcaaccaagagactatcagcttttgttgaacggtcaattagatatggatatcatggggcgctatatgcggctagcgaatcagtatagcattttgtttactgtcaaaaatagtcacttttatcatcataatctagatagtgcagcgattatcctgtgcgctgaccatgcacttaatcgaactgaagttgacatattgcagcgatacccacaaattgctcagagataaatcggaaaaactaccatcaagattagctgaaatcttgatggtagttttttagcgtttaccgaatttattatctgtaattaaatcgatcgtatgattcattcgatcacgatacttcgcattctctaatagcatggcggcgataatatcaagagcgtaggttatggcaaattgcgagttaacaaagcgcgagttgttgacgaatttgctgttttttacgagaatcgtaagatcacttagttctgctaagcgactgcgttcatcagacgtaatggcaataactttggcttgcttctttttggctaacgcaactgagtcgttgacttctgctgtagcaccagtaagagaaatggccaagataatatcaccaggttgcatgatgccaccgctgatgtacatgatatgggtgtcggtcatcgagaaagcggcaatccccattcgaattaagcgctgggtcatctcttgtgcggtatagcccgagctacccagaccgtacagatagactcggcgagccttggagattaaattaacggcggcatggagatcgtcgggggataatcgttcccacgttccactcagtattttcttgtagtaactatagacctggtccgcaacggtatcttttttgtcagtggttgttgcagggacaactggcccttcggctaattgaattttgaaggcgtaaaagttttcacagcccatttttttgacaaaacgggtaatggtcgcattactaacgtgaacgttcttagccagactagaaatcgtcattttttggacttctttcggctcttgaatgacctttaaggcgactttgcgttcttgtcgtgagagtgtcggatacgactcctcgacagtagttacaatactcatagatttggctcccatcatggtttccttatgttaacgctacaatagcatagtttgggaaaaatggaaatatcgaagggaaatagaagaattagattgaatttatacgcaatgaaaactgacatatttattgatgcggataaattggcctcgatagtttttatgtgacaatatttatttgaaatgttattagtgaaaccaagtttgactgtagttatatttgatataatagagcgtagagtatagccggcacgaggtttaaaattctattttcctgattggagtaggtgacggtatgatggagaagggagtactatcggcattaaatgagtcgatacggtagtactgagtggagtagtgtatggaaaataaatatcaaaaagtcaaagatgccctgaaagaagccattctttcgggagaatatgcaattgatgcaaaattacctacggagacggaaatgatggaacgttttgccgtctcaagatatacgattcgacgagctgtaggagaccttgaaacggagcatttcatttatcgtattcaaggcgggggaatgtttgttcaagattggcataaggactggtcgagtgaacatgacagtaaaattattggtgtgattgcgacacatgttgcagattatatctttccgcaaattatttatgggattgatcaagttatttcggagggtggttactcgttgctacttggcaatacgcataataatcatcaacgtgaacgtaaaaatttgatcaatatgctcaatagcaaggttgcggggctaatcattgaaccaactcagagtgctttggacaatcctaatatggacttgtatcaggaaattaaggataatggtattcccgtgttattcattaatgcaagttatcctaatttggattttcaagccgtcacaaccagtgaccaagaggccgaacagcggatgattgaatatttgtttgaaatgggtcatgagagcattctgggtatttttcaggtggatgatgctcagggggttcatcgtatgaatggttttgtgaaagcttatcaagagcagcctgagatttcatataagagtaatattttgatgtatcagtctggtgatccttttgaaaaattagcgcatcggctggatacttatctgcaaaataatgagcgaccaacagcaatcgcctgttacaatgaccaactagcaattcgggtgatggattatctcaaagggaagggattaaacattccaacagacatatccattgttggctttgatgattaccatatgtcacggtacatgagtccaggaattaccacgatgaatcatgagaagacgacgatgggcgaggatacggggcggcaaatgctacggttgttgcacaagcagccagtagagtcgatcgtctatacgcctaagctgattgttcgcacttcagtagcagacttaaattaaccctgttgaacttataactgtcttaatcgaaaacggattaggacagtttttttgtgcctgaaacagctagtagccgtgacaaatcggaaaaggaataaataatttgtactgataaaacaattttgtgttgatttatacgtataaatatattagactgtagttgttcgaaaatgaaagcgttttatcaaaatgtgaatcgtaataacgttgttaattaaaattcaactctttttgaaagggctttctaaaatggtttgcaattattaacaagtccagatatgaggaggaacaactttggataagcagaaaaaggtttccagtaaatttattttcttctttggttcgtttggtggcattctctttgggtatgacattggggtaatgacaggcgcattaccgtttctgaaaaccgattgggcattgactaatgcaacattggttgggtgggtgacatcagcagtaatgtttggcgcaatttttggtgctgcaattgccggtcagttggcggatcgactaggtcgtcggcggatgatcttgatgtcatcattgatttttgcaattggctcgattctgtgtggcttttcacctaacaacggaacttactatttgattggcatgcggatcttcttggggttagccgtgggtgctgcttctgcactagtacctgcatatatgtctgaaatggcaccagcacgattgcgcggtagtttatctggaattaatcagaccatgattgtgtcggggatgttaatttcttacattgttgattatattctgaaggatctacccgagaatatgtcatggcggctaatgttaggattggcagcggttccagcgattattctctttctgggagtcttgaagttgccggaatccccacggttcttaattaaagccaatcggttagacgaagcccgtcaagttttatcttttgttcgtaaaccagatgaagttgacagtgaagttaaagcgattcaatcaacagcccaaacggaggctaacaatttagaaaagacctcctgggcgaccttgttcaatgggaaatatcggtacttagtcatggcaggtgttggggttgcagcttttcaacaatttcaaggtgctaatgcaatcttttactacattccgttaatcgttgaaaaggcaaccggtagtgctgcaagttcagcactaatgtggccaattgttcaaggcatcttattagttttaggatcattactttacatttggattgctgaaaaattcaatcggcggactttattgatgttgggtggttccgtcatggcattatcattcctgctaccagctgttattaatagtttggtgccaaatgcaagtccaatgatgattgttgtcttcttatcgatttacgtggctttctactcattcacttgggcaccattgacttgggtgctcgtgggtgaagtctttccgcttgcagttcgcggtcgggcatcaggcttagcttcttcattcaattggattgggtcatgggctgtggggttattattcccaattatgacggcttcaatgtcacaagaagcagtttttgcggtgttcggtgtgatctgtgtattaggagtgctattcgttcgattctgtgttccagaaactcgtggtcactcacttgaagagattgaagcagcaggaacgaatcatcacaaacaagtacccgtacaacaagcgagtcattaattaggaggcaggtcagatgaatttagttgaaacagcccaagcgattaaaactggcaaagtttctttaggaattgagcttggctcaactcgaattaaagccgttttgatcacggacgattttaatacgattgcttcgggaagttacgtttgggaaaaccaatttgttgatggtacttggacttacgcacttgaagatgtctggaccggaattcaacaaagttatacgcaattagcagcagatgtccgcagtaaatatcacatgagtttgaagcatatcaatgctattggcattagtgccatgatgcacggatacctagcatttgatcaacaagcgaaattattagttccgtttcggacttggcgtaataacattacggggcaagcagcagatgaattgaccgaattatttgatttcaacattccacaacggtggagtatcgcacacttataccaggcaatcttaaataatgaagcgcacgttaaacaggtggacttcataacaacgctggctggctatgtaacctggaaattgtcgggtgagaaagttctaggaatcggtgatgcgtctggcgttttcccaattgatgaaacgactgacacatacaatcagacgatgttaaccaagtttagccaacttgacaaagttaaaccgtattcatgggatatccggcatattttaccgcgggttttaccagcgggagccattgctggaaagttaacggctgccggggcgagcttacttgatcagagcggcacgctcgacgctggcagtgttattgcaccgccagaaggggatgctggaacaggaatggtcggtacgaacagcgtccgtaaacgcacgggtaacatctcggtgggaacctcagcattttcgatgaacgttctagataaaccattgtctaaagtctatcgcgatattgatattgttatgacgccagatgggtcaccagttgcaatggtgcatgttaataattgttcatcagatattaatgcgtgggcaacgatttttcgtgagtttgcagcccggttgggaatggaattgaaaccggatcgattatatgaaacgttattcttggaatcaactcgcgctgatgcggatgctggagggttggctaattatagttatcaatccggtgagaatattactaagattcaagctggtcggccgctatttgtacggacaccaaacagtaaatttagtttaccgaactttatgttgactcaattatatgcggcgttcgcacccctccaacttggtatggatattcttgttaacgaagaacatgttcaaacggacgttatgattgcacagggtggattgttccgaacgccggtaattggccaacaagtattggccaacgcactgaacattccgattactgtaatgagtactgctggtgaaggcggcccatgggggatggcagtgttagccaactttgcttgtcggcaaactgcaatgaacctagaagatttcttagatcaagaagtctttaaagagccagaaagtatgacgttgagtccagaaccggaacgggtggccggatatcgtgaatttattcaacgttatcaagctggcttaccagttgaagcagcggctgggcaagcaatcaaatattagagaagagggttaataaaatgctagaagcattaaaacaagaagtttatgaggctaacatgcagcttccaaagctgggcctggttacttttacctggggcaatgtctcgggcattgaccgggaaaaaggcctattcgtgatcaagccatctggtgttgattatggtgaattaaaaccaagcgatttagtcgttgttaacttacagggtgaagtggttgaaggtaaactaaatccgtctagtgatacgccgactcatacggtgttatataacgcttttcctaatattggcggaattgtccatactcattcgccatgggcagttgcctatgcagctgctcaaatggatgtgccagctatgaacacgacccatgctgatacgttctatggtgacgtgccggccgcggatgcgctgactaaggaagaaattgaagcagattatgaaggcaacacgggtaaaaccattgtgaagacgttccaagaacggggcctcgattatgaagctgtaccagcctcattagtcagccagcacggcccatttgcttggggaccaacgccagctaaagccgtttacaatgctaaagtgttggaagtggttgccgaagaagattatcatactgcgcaattgacccgtgcaagtagcgaattaccacaatatttattagataagcattatttacgtaagcatggtgcaagtgcctattatggtcaaaatactgcgcattctaaggatcatgcagttcgcaagtaataaggattagttgaattaaaaaacatacaaatagacgaggagtgcttaattatgttatcagtacctgattatgagttttggtttgttaccggttcacaacacctttatggtgaagaacaattgaagtctgttgctaaggatgcgcaagatattgcggataaattgaatgcaagcggcaagttaccttataaagtagtctttaaggatgttatgacgacggctgaaagtatcaccaactttatgaaagaagttaattacaatgataaggtagccggtgttattacttggatgcacacattctcaccagctaagaactggattcgtggaactgaactgttacaaaaaccattattacacttagcaacgcaatatttgaataatattccatatgcagacattgactttgattacatgaaccttaaccaaagtgcccatggcgaccgcgagtatgcctacattaacgcccggttgcagaaacataataagattgtttacggctattggggcgatgaagatgtgcaagagcagattgcacgttgggaagacgtcgccgtagcgtacaatgagagctttaaagttaaggttgctcgctttggcgacacaatgcgtaatgtggccgttactgaaggtgacaaggttgaggctcaaattaagatgggctggacagttgactattatggtatcggtgacttagttgaagagatcaataaggtttcggatgctgatgttgataaggaatacgctgacttggagtctcggtatgaaatggtccaaggtgataacgatgcggacacgtataaacattcagttcgggttcaattggcacaatatctgggtattaagcggttcttagaaagaggcggttacacagcctttaccacgaactttgaagatctttgggggatggagcaattacctggtctagcttcacaattattaattcgtgatgggtatggttttggtgctgaaggtgactggaagacggctgctttaggacgggttatgaagattatgtctcacaacaagcaaaccgcctttatggaagactacacgttagacttgcgtcatggtcatgaagcaatcttaggttcacacatgttggaagttgatccgtctatcgcaagtgataaaccacgggtcgaagttcatccattggatattgggggtaaagctgatcctgctcgcctagtatttactggttcagaaggtgaagcaattgatgtcaccgttgccgatttccgtgatgggttcaagatgattagctacgcggtagatgcgaataagccagaagccgaaacacctaatttaccagttgctaagcaattatggaccccaaagatgggcttgaagaagggtgcactagaatggatgcaagctggtggtggtcaccacacgatgctgtccttctcgttaactgaagaacaaatggaagactatgcaaccatggttggcatgactaaggcattcttaaagtaaagtgaatatcacaaagtggttgtggttacttattgtggccataaccatttttattcagaatcagaagtggagtgattagtgtgattaagagtgaaaaggccaaaatgattgctggtgagttgtttaatgtttatgacccagagctagtcagtgagcgagccatagcacggcaacaagtagaagctttcaatcagctcggtgagacgaatccccataaaagccaacaaataattaaacgattatttaccgcttggatttcacagattggtatttatgaaattatgtggtttgacgtattaattgctggaattggtgttctttgcagtattgtagttcttaccctatcgcgagaaaagaagacaattgttgcttagtaaaaaatctctcaggtctataacacgcattatcactagtctggcgataatgcatgttgcaaacccgagagttttttgtcctaaattaaacgttcctgttgtgtgtaatgttgccaacagtaactgcgactgaattcttcaaatcgactaactgaaggtgtaacaaaatgattacgtttgctgatgaggtatatttggtgacgtagtggctgatcggctaagtgcttcaacgttatgctggtctggtctaaaagcggtaagtatggcatcaaagcaacgccaaaattatagctcacaaagccagccatggtatggtcctcctcgacttcgcaaacgatttttggtttcacatgcgcctgccttagaattcgatcaatcaaaggacgtaaaccactattatgtgagaaaaatatcatgggatatggttccaagtctttaacgaataattcttcttgtttggctaacgcgtggtggctagggacagccgccacaatttcttgttgaaccaatggaataaaatcaaacaaggtattagtgggttgctcgccaaggcgttcgacacttgaggctaacactaaatcaaacttttcatcagcaagttcttggagtaattcagttgagtttccttgaccgagttcaaatgtaattgcatgatttttatcatctgtatggaacttagtgattagttcggggactagctgctgtccaagtgtataagtaaaccccaatttaacatgtcctttgtcaggatccattaattgctgaacgagttcattgccttgtgataaatcgcttaaacttgccgtaatatattttaaatacacggaaccaatcggtgttaaacgaatattacgaccatctggttcaaataaagggacccccaattcactttctaactttttaatggcatagctcaatgaaggttgtgagataccaaggttttcagccgcttttgccatatgttgtgtccgtgctaattctttaaaaaattctaagtgtcttagattcaatctacatgatacccctttcattcataaaagaatttaatcgatttagcaactgttctatatttattataggcagattgtaaaatttaagttgaacatttaagtggacagaaaaacccatcaaggtctttaatggtgttaccacacaatccattagaaagaaggaccttgatgagcaccactattttatcattccagaaccgtgttgtcattgaaacgcttcataatgaaggacgttccttgcgatacatcgctaactacttaggctttagtaagaccaccatctttaacgaacttcaccggctaaatagtgagtaccaggctgggctagcgcaaactgactttgaacgaaaggttagtcaacgggggcggaagtcttcgctcactaaaaaccttaaacacttgatcgaggaaaagattcaagtccagaagtggtcccctgaacaagttgcccatgtggtggggattgcctacaagacggtctataactggattgatcaaggatggcttgatatacagttgcccgatttgcctgatcatggaattcgtcgtcatcgtgctaaagaaaagcgtggtacgttcaatcacggccgctccattgaggagcggcctcataaagtcgaaactcgccaggaattcggccactttgaagctgataccgtactttctggtaaacgtaaaggtcaagctgtggctacttttgtggagcgtaagagtcgcctgacaattgttaaacggctccatggtcgcgacagtcagtccatgactcaagccgtacttgaactagctagtcaacttcaagacaagctcaagacgcttaccgtagatcatggtaaagagttcgctaactatcagacaattgaacggcgaactggtacacaggtttattttgcacatgcctattcaccgcatgaaagaggcagtaatgagaaccgtaaccgagttttgcggcgctttattcccaaaggccaagccattgaagaactaagtgatcaccaactggttcaaatcaactggtatttgaattcacggccacttaaatgtcttaattggcatacaccaatcgagatcttcttgcttaatttacgtcattaaattcgttcaagttatttcttgcaatctgcctatattaaagcattttgttaagatgacaagtgaattgagtaacaaatattaaaaatataaatttataggagtggattaacatgactgaacgcattgatggacacacattattaattggattgatggcatacccgattcggcattcaatgtcaccaacgatgcacaataatgcatttgctaaattaggactgaactatgcatatctagcattcgaaatcgataacaaaaagctaccttcagcaattgaatcgattcggacgttagatatgcggggttctaatgtttcaatgcctaataagcagaaggttttgccactgctagacaaattagacccagctgctgagatgtgtggtgcggtcaacactattgttaatgatgatggaattttaaccggttacacgactgatggtattggttttatgaagtctctggacgatgaaggaattaatattcgtggtcataagatgacgttagcaggtgccggtggtgctggaactgcaattgctgttcaagcagctttggacggagttagtgaaatgtcaatctttaacttacatgatgcagagtgggaaaatgctaaacataacgttgatttgatcaacgagcggacttcctgccatgctactttacacgaattagaagatcgtgatgattttaagaaggaaattcaagattcatatatttatactgacgctaccggtgttggtatgaagccgttagaagacaagactttagtcgatgatccaagttggttacgtaaggacctgattgtgttcgacaccgtatacgcaccacggacaactaagttaatgaaggttgcccaagaagctggcgttgaacatgtctttaatggtttgggtatgatgctcgaacaaggtgctgctgcctttaagctctggactggtgaagatatgccagtggattatattcgccatattttatttgatgaagatgctgcagcacaaaaatagacgggggttgccatgaaaaataaatatatgccgacagccattagcttatatttaaactattttattcatgggattggggttattattttagcccaaaacatggaagctttggctcaacactggcagacgactacaggtggtgttgccgtggtaatttcatcacttggaattggtcgtttgattgttttgttagtttctggatttctatcagataagtttggccgtaaaccattcgtggttcttggtgttgttacgtacttgctcttctttgctggtattctattaagcccttcaattacggtggcttatgtttttgggatacttgctgggatagcgaactcattccttgattctgggacttatccggcattaatggaaatgtttccagattcaaaaggaactgcgaacgttattatcaaggccttcatttctgttggtcaatttggattgccgttattcgttagtttcttagttgctggtaattattggtacggttggtcgtttatcttctgtattgttgtattagttgttaacttactattcatgttggctgctgggaagttcccagttgctaatcaggatgctaaagttgctgcgaaagaagaaggtaagacagttcaatctgaatcaaagggtagcttatggtttgatggaacgctatttatcttatatggttatgtatctcaggcaaccttctacttagttagtcaatggttgagtcagtatggtgcaaaggttgccggcatgggcgatgcaagttcacgagcactgatcagttattatagtgttgggtcaatcgtttgtgtactggtgacggctgcgctagctaaacgtgctgtaaaagaaattcaattcttaggcatctataccttactttcatttctctcgttactactgatgtatctggtaccaacatctttgatgtgttcaatcatgtcatttgttgttggattctcagctgctggtggggttatgcaattaggattgacagtcatgtccaccttcttcccacaaggaaaggggacgattaccggtgctttttatacagcggggtcgattgcgtcctttacgataccgttagttacaggtatgatgtcaactaatcttgcaaacattttcttgtttgacgttattattgcgttgattggatttgtattggctgtactcattacagttcgctattaccacttgtttggcaagaacagtcaaaaggaggtcacgattgatcatgacaccaatcgttaaattacgtgatattgaattaggaacgggacggcctaagattgccgttccaattacgggaaaaactattgcggatattttagctgcagttgaaccaataaaggctgcacagccagatgtcgttgaatggcgaattgattttttcaaggatgtaattaatccagaaaagttgaaatcggccggtcagcaacttcgtcaggctttaggtgatattgccttattaactactttccgaactaaaggtgaaggcggcgaattagcactatcagatactgagtattttaaactgtgtgagacggtcttagatggtgggttcacggatgccttagatgttgagcgttaccatgacgaacaagctgttaaacaaattgttgcagcagctcatgagcatcaagtagttgtgatcatgagtaatcatgattttgataaaacgccggcggttgctgagatcgttaagcgactgactagtatggtcgattatggtgctgacgttgctaagatggctgtgatgccacaatcggtggaggatgtcttaacattactgacagcgactaatattgcacgacaaacactaccacagccagtaatcacaatgtcgatgggtgacttaggaaaagtgtcacggcttgctggtgaagtgttcggctcttgtttatcatttgcaacggtcggggcggcttcggcacctggacaaattgcacttgaaaacttacggccggaattggaagatctgaagttaaattaaggcataactgaaagaaattgtgaggtcagagtgatgattgggacacaaaaaaagtatgtttcacaatttacgatgatgggaaccgtcatctcgctgacattatttgagtcgaatcagttagcggtcgaagcggtctatgattacttgcagcggatggatggtgtcttttctgtcaatcgtgccgattcagaattagctgcgatcaatcaatatgccggtattcatccagttttggttagcactgaatgctttcaactagtgtcggatgctattaggtacacaaagcaatatgcagatagttttaatgtgctaataggaccgttggttaaactttggaagattggttttggtgggcatcaagtaccagcggccaaggaaattagacaacgattagccttattagatacgaacgaagttatcctagatgaggcccaatcgagtatctacttgcgtcaatctggcatgcaattagatcttggtgcgattgccaaggggtattttgctgatcaggtcgttaagcagttgcagcaggctggcattaccagcgctattgttaatcttggtggtaacgttaagctattagggaccaatccgctaaccgataatcggcgttggcaagttggaattcaagcacccgaagcgccacgtggctatccagcgctacaggtcgaaatgcctgccagaacggtagtgacgtcaggtatcttcgaacgatattttaaaattggcaatcaccgctaccaccatatccttgatccgcgaactggttatccggttgaaaatcaagttgatcaggtgtcgattataactgaacggtcagaattagctgaagtgttatcaacggtggcctactttgaagggccaaaccgtggtcgtcaactaatcgaacagttgccacatacggaagcaatttttattgatcatgaacaacaggtaacagttaccagtggcttaacgccgcgacgcaaaggagtgtttactattgagtaaaaaacaaattaccggccaagcaatgggccacaacggtattatcaattatgaagttgacgtgcaagataataagattgaggatttgaaaatattaaagcattccgaaacgtcggggatctttaatcaagtcattgataaattgaaacaaaatatcattacggaacaatcattcaatgttgacacaattagtggtgcaacggtgatgacccaagcgctacttaagtcggcagataaggctgtaaccgatgctggtgttgatgtgcagccagttcctaagaaaaaagcccccaagacgcaaaacttgcggaccgacgtgctcattattggtggcggagaagcgggcttagtcgctggctgtcgagcgttgacaatgggtcagaaggtcatcttagttgaaaagaacggctatcttggtggtgcgacaattctgaatggctctaacgttgttggtaccgggtctgatgttgctgcgcaaatttttgataataatcatgatacgccagaaatgttggcacaagatgttgctcgtgaaagcttggagacgaactatccagccttgaccgacctaatggtgcataacattggtccagccattgattttattagtaagtttgcagatttacattatcaaaaagcacagacgcaaacgccagaacattcgattaaccgtcagattgaactaccttcagcaagtagctatgaattcattcaaaaagtttcgaaggcgtttgccgctgcgggtggtcaaattatgttggatacccgagtcgaaaagcttatgttaggcaacgataaaaagttacgcggtgtgattgctgctcaaaaggaccaaacagtcaacatcaaggcgcgctcagttgtgcttgctgcaggtggtcatggcgctaaccaaaagatgcgtggtactgaaagcgaaggcattgattattatggcccaatgacttccactggggatgcctatcaatttaatggtgatttggatttgcaaacgcacgatttaggttggtacaagctgtatccacacggtgttgaagtggaaccaggcgttgctaaattgaccacgtacgcgtcgaaacaagcgactgatatgggtgcaatttacgttaactctaagggtgatcgaatcgttaacgaatcaaatgtttatacgacttttcggaatgctatccttaaacaagcggataaagttgcttacctagtaatggatgaacggacttggaagaaagtttacgacctactgatcctgcatgatttcacaccagaagaaattaagagcttctttgagaataagggtaaacggccagtatttgttaagggttctttggaaagtgctgctgagcaggccggaattgtggttgatgaattagtccaaacggtcaaaaattatcaaggctatgttcaagatggtcacgatcatgatttcggtcgtgatccgaagtacttgcaccaatttgaaggtgaaacattctacatcattgaacaacgtgatcgctttgcgacgactttaggtggctatagtgttgatgctgataacttgcaattggtaacgactaaaaatgcaccggtagctaattactttggtgcgggggaaatcatcggcggcgctaacggacatgattcaatgccaagtatgatgaatacttgggggatttcgtcgggttacgttgccggcgccgcggctagcgaaaacgctcagcggcaggcaaccgcgggcgatgacgaagccaatattgtggccattgtggggactaacgcttcaaaatcatataaccgtaagttgttgtatgccatgaaagaattatttgaaacgcaagttaattttgaaatttgtgaaattaaagatttaccgctattcaatgaagatgatatggatcgggaaccggcaagtgtaaaagcgttagccgctaagattgaagccgctgatggtgtcgtctttggcgtgccagaatatgatcattcgattccagctgccttgaagagtgccattgaatggctgtcctgtgcagaacatccattcaaagacaaaccagtgatgattgttgggacttcgttaggtattcaaggcacggtacgtgctcagatgaacttacgacagattttggactcacccggtgtggatgccaaagttatgcctggtaacgagttcatgttacctcaagccggcaataagtttgatgagaacgatcatctgaatgatgacggtagtgaacacttcttgaagcagtgctttgggcactttttagaggggcttgaattagcatctaagaagacagtgacgaattaactactgtctagactaaaagaacgtacacaactcgtgtacgttcttttagtctagattttagttgttaaatcttttgttccacatcgtcgattgtgacaaccagggtcgcgcgaatccaatcaaacttagtatgcatttgatcgaaataagcgccactagtttcaaacttgccggtaccatgaatgtggaaaccacagccagtaccagttgtgccgggaaccttgtaactaccgacagcaattgtaatgtggttgtcggtagcaaaatcggcttcaattgagtgcatgccagccgatgggatcaatagggtatgatcatcaataagctgcatataatgactccaggtgttgacgacgtgtgctggtgcggcgttgaccgtgacgatggttgcgggggtcgtgtctttgatcacttcaataaatttagggtccataataagtactcctttacgtttatattctcataatatattgtaattgatatatataaattatcaagtgagagtgttcgatgtctcaataatcttagcggaggtagcatggtaaaaccaggcgttgctttttactaatgaaagcggtaactttagctaggaacgaataacgagagggtgtttaatatgtatcaagcaagccagaagcgctatgaccatatgatttataatcgagtaggcaatagtggtttgaagctgtcagcaatcgggctaggtctttggaataattttggaagcgttgatccgatcgctaatcaaaaggcaatcattcatcaagcttttgatttgggaattacctactacgacttagccaataactatggcccggagcccggcagtgcagaaactaattttggtcgtattatggctaccgatatgcggccataccgtgacgaaatggtcattgctagtaaagcgggctatgtgatgtggccgggaccatacggcaattgggggtcacgaaaaagtattattgccagtgctgatcagagtctgcagcgaactggtttagactactttgatattttttatagtcaccgtcctgatcctgaaacaccaatggaggagacggccactgcgcttgatcagctagtacggcagggtaagacactgtatgtaggcatttcaaattataatggcaagcagacggctgctatgaccaagatatttgaatcattaggaaccccatacattattcaccaaccacgctataatatgtttaatcgacaggtggaacaggacttgttccccgttctacaagcaactcataaggcggcggttggctttagctcactatcacaggggttattgacggacaagtatctgcacggaatcacgacagattcacgggccaataagcaaacaattccatttttgagtccagtccaggtagaacagacactagctacggtaaagcgcttaaatgaagtcgcgcaacaacgggagcaaagcttagctcaaatggctttggcttggaacctacgtcagccagccttagcaagtgtcttgattggtgctagccggccagagcaggtggttaataacgttgctgcattggaaaagttgaaatttagtgaatcagaattagcaacgattgaacagattcttaccgaacaaccggcaattgattggaatgctggtcgatcatagcgtttgcacaattcgctatagtcaatgttatagagccgcaaaagaaagggccatatccgaggatatggccctttctgtacctaatagttaagttaataataacatagttttgcagatttgcacgcacaggggggcctttactaaataaattagtgtttaaattcgccaattttcacaattaatgataaagttttacatgatagttatcacgattatgcgttgaagttcggcgcaatacttgaaaattaaaataatttgcaaataaatcatgcgatagcgactttagatggtagtaagaattagtttgaatttaagggggccaattcatggcggcgacgctaaaagatattgcaaataaagttggcgtatcattggcaacggtatcgcgcgtgttaaacaaagatcagtcattgtctgttagtgatacaacgcgccaacgaattctagatgcagcagaagcattacagtattcaaaaaataaacggcatactgtcacgacggcgcgtaagcgacttgctattgttcaatggtattcggaatctaaggaacaagatgatttgtattatatgtcggtccggatggggattgaacgtcgtggacaggataatcagtttgaagtgactcggattttccaaaataatttacaagaattgggaccagacgtagatgcagtgattgcagttggaaagttcagcgagccacaagtcaaggacttggcatcagtaactgacaacttagtattcgtagatgatgatcagtttgatgctggttttgatagtgtcattactgattttcggttggccacagaaaaagttgtcgattatttttggcaacgcaactttcatcatattggctttattcacggtcaagaaatgacaaccgaccatcagttagcggtagttgatcgacgcatgctaggttttcgggccgcgatggaacgacggcatgcgtttgatcctaagttcgtttttaagggcgattatactagtgaatctgggtttaaaatgatgcaaaaagccattcgtaagttgggagaccagctaccaggagccttctttgtggcaaatgatccgatggcggcaggtgcgcttaaagcgttgcaagctagtggcatccaggtgccagaacgagtgaagctatttagctttaacaatacttcgctggcgacattcgtttatcccgaattaagcgcagttaacgtagatactgagttaatgggggcgaccgcagttaatttggtcatcagtcgactagcagggcgaacaacgacacaacgggttgagctgggtactaatctggttgagcgagcaagttccaagtagtgaagggcgatctgggatagaaaccagatcgttcttttagcattttaactaaaagttttactcaacttcaagaaattctggtatacttctaaatgaaagcggtttaaataacacggaggtgcatgattttggaaactaaaaaaacggtgtttgaccaactagatggtcaagatgtaatgcgttatacgctggtcaatgaccatcaaactcgtatctcggtccttagttatggtgggacgtggcaagaattcgtcgtcaatgaagacggcgttgaacatcccttgatttggggccttgataacatgactgactatcaacgagtgggatactgcctatgtcaatcaattggtcgggttgctggccggattggcggcgctaagttcaaaatcgatgatcaatcctatcaagttgatatgaacgaacaaacccattcgctacacggcgggaatcatggttttaacacgctgaactttgaaggtgcttttagccaaaccaatgatagtgtcagtgtgactttgaagaagcatatcaacgccagtgatgataattacccgggaaatatggatgtcgctatcaagtttacattagataatcaggatcaagtatccattgcatttaccggtgatactgatgcagcaaccctctttaatccaactaatcacgtttattggaacacaactgatgatcggaccagtttggcccaacaaaaattacagattacgagtgcagctcacttggaatttgatgatgaaaaagtcccaactggtaagaaattagcagttaaaggcacagcgtatgactttaaccaggcgcaaccagtggaaaaggcgttagcccagctgaagactgagaatggtggcattgaatttgacgatgcgtatgaagtcgccccaagtgcggcagaaccaattgctatcgttgaggatactgatgataagcgccaagtaaaaatttattcagatcgcaatagtcttattatcttcacggctaatccgtttgatgctgataaggaagatgcgcatcaatataatgcgttagcgacggaagcccagacacttcctgatgcaatcaatcatcctggttttggtgatattgtgttacgtccaggagcaccagtgacgcatacgattcggtaccaatatgaacggttaaattaatactagttgaggtgtcaggcgagttctgcctggcgccttttttgtaaacgtatgagtaaacaatgtttaatttagttaacaaagtcccgagcatctgattaataccgtgattagtaaaacgatgatcattggtaagataatgagtactatactgcttaagcccttggaaagcgggcaatcagtgtcgataggcgcattagcaggtcctaatcaaaagcggtatagataaaacttttgaacaaattttactaaaaatcattgacattacttctgaaaacgattacatttaaacttgtaaattattcaaggaagatgtgaggcgagattatggatgcagagacaaagcagagtaaaggtcgtaaaataacatcgcgacttgcttattcgtttggggcgtttgggcacgatgccttctatgccactttatcaacttattttattatgtttgtgacctcccacttgttcgataagagtagtggggctcaaggaacacaaatgattgcttggatcaccatgattattgcaggtttgcggttcgtggaactagcaattgatcctttgatcgggaatgccattgataatactaattctcggtggggccactttaaaccatggattgtcattggtgggattataggttccgtcgttttagcacttttattcacgagtttaggcggattaaatacctcaaaccccattctatatttaattatttttgcaattttatacattacaatggatattttctattcgtttaaagatgttggtttttggtcaatgattccagcaatctcatttgactcagcagaacgtgaaaagacggcgacatacgcccgggttggctctaacattggtgccaacatcgttggggttatcgttatgccaatcgtcttaatgttttctgttaagtctaacagtggtcaaggtgacaaccgtggttggatggcatttgggatcattattgccgcaatcgctttgatttctgccttagttgttgcacttggaaccaaagaaaatgattctgaattgcgtaagaacactgaaaagactagcttcaaggaagtcttcaaagtgttagcccgtaacgatcaattgatgtggttatcattgatgtatgggatctacacggcagggattgccattacgaactcactagaactttactacttcacctatattttgggtgacgcctcgaagtttacactattaggttcgctaaatgcgattattgggatttttgccgtattggccttcccaccattagcaaagaagtttagtcgtcgtaaagtgttcttcttagcagttgttattatgatgatttcactgatcatgtttgcctttgctggtcagtcattaccaatgatcttaacagcggccgtattattctacattccacaaccattaattttcttagttgttttgatggttttgagtgattctgttgaatatgggcagttgaagtttggtcatcgtgacgaatctttaaccttatccgttcggcctttacttgataaattaggcggtgcgatttctaacggtgtcgttggtttaactgctgtttgggctgggatgacagctggtgccactgctggtgatgtgactagccatggcgctgccatcttcaagttaatgatgttcggtgtacctgctgctatgattttgattgggacattcatcttcttcaagaaggttaagttggatgaaaagatgcatgcacaaatcgttgatgaacttgaaaaaacatggtcaactcacttggaaaccgatgaaactcctgctgaagttgaagcagaagccgatgccaagacgacggtttatcaagatcctgttgccggggaactgatcagtttgaaagatgttgctgacgaatccttcgcaaacggtagtatgggtaaaggtttcgccattaaaccaacggatggtcgcgttgtcgcaccatttgatggtgaagttgttgcaaccttcccgactcgccatgcaatcggattacgttctgataccggtattttaacgctaattcatattgggattggtaccgttaagatgcgtgggactggatttgttcagtacgttgagaagggcgaccatgtcacacaagggcaagaattaattgaattctggcaaccagcaattgaaaaggctggcttggatgataccgttatggtcgttattacaaactataaagatatgcccgaatttacgtatcttaaagattcaggaaccaccgtacaagatgatgaagatgtcttacaattatcgaatgtcggcttaccggatcaagcatagtttctttacgaggagagctattaatgacgcgagccattaatagctctttttgtgaactgaaatagaaaaagctaatagcgaagggaagattttactatggcagtaacgttgcagcaaactttaattgacattgatgaagaacaacttgtctttcacctgcataacgatcaaatctcgtatattctaggtgtggagacaggcaacgtgttggcccacttgtactttggcccacgggttcggggttatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaagactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgggatcggccagttatcacgcgtagcgcccggttgattaatcacagtgagcaagctgtcgacttagaaaaagtggcttcgatgcagatggacctgccaacccaaccattagatgccatttcgttacctggaagctatgcgcgtgagcgccagcttagtcgtgaacggctccatcgaggtgtaactcagtttgaaagtcgccggggtgctagttctcatcatatgaatccttttgtggcgctagctgatccgaatactaatgaatttcaaggcaatgtccttggtgcattgctaatttattcaggtaaccaccagattagtttagaacgggacccaattggtcagacacgcttgactatgggaatcaatgaatataacttcgactggcgattggcggccggtgatagtttccaaacgcccgaggttgcaatggtatactcgacgacggggcttaatggtatgtcgcaaacctaccatgatttattgcgtgatcgcgtggcgcgcagtcgttacaagcacgatctccggccgatcttgatcaacaattgggaagccacttactttgactttgatgcggacaagattcaatcaatcttggatgctgcagcaccactgggtatcgaaatgtttgtgctggatgacggttggttcggtcatcgaaatgatgataatagttcgctaggtgactggtttgttaatcggaacaagttaccaggaggcttagcggatattagcaaacggacccatgataaagggatgcggttcggactttggttcgagccagaaaatatttcggctgattccgaactctatcgggcccatcctgactgggtgctaggcgtaccggatcgtggtcgaacgttatcgcggaacgaatacgtgcttgatttcagccagccggatgttgtcgacaatatttttgaacaaatgaccgcagttcttgataaggtgcccattgattatatcaagtgggatatgaaccgcaatttaacggaagtctattcgccacatagcgattcaactcatgaaggtgagactagccaccgctttatcttaggtgtatatgacttgatggagcgtttaacgaaacgctatccacagatcttatttgaaggctgctctggcggtggtggccgctttgatgctggtttaatgtattatatgccacagagttggccatcagataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcaggccgttaaaagacaggttgccttctataagcagcaccgtgagttagttcaatacgggaccttttatcgattagagagcccgtttgaatctaatacggtggcgtggatgtttgttagtccggatcagaaagaagccttgctgttcaccttcgttattttaggtgcagttcaaccagaaccgcatattacgaagttagcgggattagaccctcagcagacctacgttgagaccgacacaaacaaaatgtacggtggcgatgaattgatgcaactaggactctacacgactcccgttcaaactagtgactttacggcgcaggtacattacttcaaggctaaagactaagctcagccattaaacatattaaaacttaatcatcgttaatctaaaagaacgctctggcaaataactcgccggagcgttcttttgaaatcaaaataacttttagaaatgaatattaaagctgaagtcaatgtcttgatcagcggggatatgatatggggattctacgtctgttccccaactatcaatgccaccgaccccacgaacggcaccgtagattgataagaccgttcgccgtgctaatggtaattcttccatgtgcgttgcgttttctagttcagcggcggtatagggaaggcagctgaaggcgaatggtgcatcggcttggctaaatgtcaaactgaacggtgtgttgtcgtggtcagcgttattttgtgttgttgatcgcgttactgtcacttgttcagtttgcatgtgcatgccgcattcttgtgggaccaagtatggtgtgactggcagactgtcaacgtggaatcgcccgtgcgttgcgccggccagccggtcaggataagtctcaccggacaaaccggtatagtcgaagccggtcgcggtagttggtatgataaaccgcagaccaaatgcgggtagctctggcaaatcagactgaccgctataatgggtggcgatattgatctgaccgtctgctgtcaccgtataagtcactgtgacgatggtactaggaacggtcgtggtaatgaagtggtaagccagtgagactttcgtggcgatttcgtgatccgtgtatttgttattgagtggcgcgattggtaacggtgtgactggttggtcgtcaaccgtcaattcgatatcttgacaagttgagaacttatcggccgcgtaccactgtgcggatttgactgaaaagccgctaccgtgatcattatcggttgtcgcccgccaaaagatgggcgtgggtgtacgatagagccactctttatcgttgacgacgagtgattcaagtccgccacgttcgtagctaaagaggtagtggaaattagccccctgtagtcctaaactcccgtcgccgtaaataacgtgtagttgattatttgtgtaagccataataatatttcacctcttgcattgctggttttggtgtccggtcggcaaacattaagccgtcaccggagaattcataatcggagtggcgttcgtcgaaatcaccgccataccggagcacgtcttggtcggtaattgggtcatgaacgaagagggcttgatcaataaagtcccaaataaagccaccttgatacatcggatacttgtcgatcaaatcattatatgattgcataccgcccagagaattccccatgtcatgcatatattcacaatctaggaaaggtttggttgggttatcttccaagtaagctacaatattttggggcttttcgtacatccgactttcaacatcagaaatgcgatcttttaattctggtgtgtggacaacaccttcgtagtggacgagtcgtgaatcatcgtgttctttataaaaagcctgcatcgccgcgatatcttcgccagcatacgattcattgccaagtgaccaaaaaatgatcgatgggtggtttttaaaccattcgtagttcgaacgggcccggtcgatcaccgctgctaaccagtgtggattatcgccaggaacattgtaagaaggctcgatagcacccatcttttgccatgacccgtgcgattcgaggttgttttcggccattaggtagataccggcctcgtcacataattgataccaaggtaattgatcaggataatggcaggtccgatcggcattgatattgttagctaacatggtttggatatcagcgcgcatatcatccatactgataacgcgaccggtgtgggcgttccattcgtgccggttaaccccgttgatcaccaaccgtttattgttgacgtaaatgactttgtcatcgcgcagctcgaccgtccggaacccaaactgatatgggacgacttccaagagttggcgatcagcatcgtaaacttcaattgtcaattgatagagatacggcgtttgtggtgaccacaagtgcagttggtcgaataacatggtatcaaaggttacactgccactaccggtttgcgtttgactcgtcagtactcgcccgtcatggtctttaacggtcagcgctaaagtggctggttcaccggttactttagtagtgatgttgagctcaccacttttgagattggcatttggaactggtcggatgtccaaatcagtaatatggctagcaggctccgccagtatattgacgtcacggaaaataccagagaaacggaacatatcttggtcttcaataaaggcagcagtactgcgtttgtagacccgaaccgctaaaacgttaccttggtcctgaatatacggcgtcaaatcaaattctgaaggggtgaaactatcttcagcgtagccaataaaatggccatttaaccagacgtacagggcttcttctaccccttggaactgaatgataatacgttgccctttaaaagcatcgtcgagatcaaaggttttgaggtacgagccgacggtgttgtccgcagcgtcgctgaataggcctggtgttaattgatcttgattgagggtatacggtgggcgacgataaattttaccttcccatgggtatagcgtgttaatgtattgaatttgaccatagccggctagttcaatatgaccgggaacttgaatcgtatcaaagtcggttgcatcgaaatcgggttgataaaaatcaactgggcgttcagccggtgtcttggcgaagttaaaacgccaagcgccattgagactcttgatgaagcgactacccgttttgaattctgctgtgtcgtgataataatggtgatcactatgtgcaggtaattggttgacccggaagacttctgggtcatctaaccattgaagattagcttgcatgaggaagctcctttcaaagttacataaataaaaacgcttacaattatcataaaacaaaatattaaatttgtatatgtcgttttagttaaactttaactaaatgacaacaactactgacaacgacaacgggcgataagaagaatttgaatcgataacgtgataaatttgtaaagcgttaccaaatcttgttctaaaggtcttgtggggtgttgacaacaatcaaaaaaagcattatagtcaaactaataaaattttagtaaaactatttacggagggatttttcatgaatactagcgacttaaaacaggagtttaccgaagcctttgataccaagccagaacgggtctttttctcacctggtcgaatcaacttgatcggtgaacatactgattataacgggggccatgttttcccatgtgcgattacaatcgggacatatggtgtttatgcaccccggacagatacgacagtgcggatgtactcagctaatattccagatgctgggatcgtcacgtttgatgtcaacgacctttcatatgacaaagccgctggttggacaaattatcctaagggaatgatggacgaaatcgcgaagaccggcgttaaattcgatcatggttttgatttctacgtccatggcaacatgcctgatggtgctggattatcatcatctgcgtcaattgagttattaactggaatcatgttaaacactggttttaatctcggtattagccaattagatcttgttaagattggtcaaaagtgcgaaaacaactatgttggtgttaactccgggatcatggatcaatttgctgttggaatgggtaaaaaggaccaagcaattttacttgataccaacaccatggactattcttatgcacccgtaaagttaggcaacaacgtaatcgttatcatgaatacgaacaaacggcgcgaattggcggattcaaaatataatgaacgccgctccgaatgtgaagaagcattacgccgattacaaactaagttagacatcaaatcacttggcgatttaactaacgaccagtttgacgaagcggcctacttaatcaatgatgaaaccttaatcaaacgtgcccggcatgccgttttcgaaaatcaacgtgccattcgcgcaactaaggccttggctgacgatgatttaacgacctttggcgaattagtgacggcttcccacgtttcactacactttgactatgaagtgactgggaaagaattggatacgttggccgaaacagcttggaaacaaccaggcgtgcttggtgcgcggatgactggtgctggctttggtggctgtggtattgccatcgttgataaggaccaagtcgatgcctttaaggaaaacgtcggtaaagtttatcgcgacacgattggttacgacgctgatttctacattgctgaaatcgcagacggccctaaggaactttaataaaagaattgatttaaaatacaaattagcagtaagcattgagaaatattgaggaggaattagaatggcagttttagttttaggtggtgccggctacatcggttcacacgcagttgatcggttggttgcaaaggggtatgacgtggcggttgttgataacttggtcacggggcaccgggcagcagtcaatgaacacgcgcgtttttatgaaggtgatgtccgggatacggtgttcatgaataccgtgtttgaccaagaaaacgttgaaggtgtcattcattttgcagctttctcagttgttcctgaatcgatgaaggatccgctcaagtactttgataacaacacggcagggatggttaagttgctcgaagtgatggctaagcacgatgtgaagaaaatcgtcttctcatcgaccgcagcaacttatggtgaacctaagcaggtgccaatcaaggaatcggacccacaagtgccaactaacccatacggcgaaagtaaattagcgatggaaaagatcatgcactggtcagatgtggcttacgggattaagttcgtggccttacgttacttcaacgtggcgggggctaagcctgacggcagcatcggcgaagatcacgcaccagaaacgcatctcgtcccaattattttacaagtagctgctggtgaacgggatcaattacaaatcttcggtgacgactatcccactccagacgggaccaatgttcgggactatgttcacgttgtcgatttagctgatgcacatatcttagccttggaatacctaaagcaggggcacgatagtgatgcgtttaacttgggttcttcaactggcttctccaacaaacaaatgttggacgctgctcgtgaagtcactggtaagccaattccagcaatcatggcaccacgccgcgctggtgatccaagcacattggttgcagctagcgacaaggcacgtactgttttaggttggacacctcagtatgatgatgtgaaagaaattatcaagacggcttggacttggaaagaaagtcatccggccggctatgatgatcggggaggccaagcataatgacgagtttggatcaatttgtcacggcggtgatcgcgtcgccttcgcaatatactgaattagatcgaatctatgtgcataaccgggttcttggtttggtcggcgagggtgatccgattgcggcaagcgatgaccaattaacaagtttaaccgatgccttggttaaaacggcgattcaaaatggcaagatcgaagcgacccaatcggatgaagatatcttagcggatcaattgatggatcttgtgaccccgttaccatccgtattaaaccaacgtttttgggataagtatcaggttagtccgcaaacggcaaccgactatttctttaacttaagcaaagctaatgattatatcaagacgcgggccattgcgaaaaacgtggtctttccagcaaaaacgccatttggtgacttagagattaccatcaacttatcaaagcctgaaaaggatcctaaagcgattgcggcagcgcgtaaccaaccgcaagatggctatccactttgccaactatgtatgcagaatgaaggctatctaggccggctcggttacccagcacggagcaatcaccgaattattcggttaacacttggtggcaatacttggggtttccaatattctccatatgcttactttaatgaacactcgattttcttggatcaagagcaccggccaatggtcattaaccggcaaacttttaccaacttacttgaaattgttcagcaatttccacattactttgtgggcagtaatgcggacttgcaaattgttggtggttcaatgctgtcacacgagcattaccaaggtggtcggcacgaatttccaatgatgaaagcgccaattgcacgcacgattgacttaggtatcgcgggtgttaaggctgggattgttaaatggccaatgtcgacgattcggctgacgagtcaggacttggttgcattaacggatgccgctgtgaagattcatgagacgtggaagaattattcggacgagagtgtggatgttcgtgcttatacggatggcacacgtcatcacacaacgacaccgattgcacgcaaagttggcgatgactacgtattagatatcgttttgcgtgataatcagacgtctgctgaatttccagatggcatcttccatccacatcaggatgttcaacatatcaagaaggaaaatattggcttgattgaagtgatgggccgggccattttaccagcccggttgaagaccgaattagctgaagtcggcaaatacttgttggatcagcctaatcaaatggtcgcgatgcatcaagcatgggctgatcaattgaaggccactaataccatcaccgctgacaatgtgacgactgtcattgatacggcggtcggcaacgtctttgcccgggttctggccgatgctggggtctttaagtgggatgacgctggtgaggcagcctttgatcgttttgtcgcagcaatgcacgattaagttgttaatcaaatgaagacgtggggcaacggggtgttgcagacgcgatttaccgatgagtcatgattggtgaatagtgtcacgcccagttgccccacgtttgttattcagtgctaattaattaagagaaaagaggaatgacgatggccgtaacgttaaaagatattgcgcaacgagcagatgtctcattggcgacggtatcgcgggtcttaaattatgacaagacactatcagtgagcgagcagacacgcaagcgcgtgtttacgattgctggcgagctgcggtacagtaagcgtaaacgtcagcatataaaggcgctaatgcggaaaaatatcgctgtgattcagtggtactctaagattcaagaacatgatgacttatattatttagcgattcgtaaaggaattgagcatcaagctcaagtgtgtggttttacgacgactagtatcttccagaataatttagatcaggttggcgatgatattgatgcaatcgtggcggtgggaaaatttagccctgtccaagtacaacagttgagtcgtttgtcaagccagcttgtttttgttgatgacgatcactttgctcagggattcagcagtgtggtgactgattttacgtttgctactaaccgcgtcgttgattatttttggcggcgtggtatccgagatatcggtatgatttatggcaaagagtggtccactgatcagcaggtggagattcccaatcaacgtcagcaaagctttgaacaggcgttgcagcggcatcatgcctatcatgctgagtatgtattagctggtgattacactagtcaatctggttatctgatgatgaaacgggccattgaaatgttaggtgaccgcttaccacacgctttctttatcgctaatgatccgatggcagccggtgcgctcaaagcgttacagcaagctgatattgctgtgccacagcgggtcaagttgtttagtttcaataacacgacgctggccgaatatgtgtatccagagattagctcggtcaatgttgagactgaactgatgggaaagacggccatcgatttgttggtgagccgattccaagatgatcgtcaagcagcccagcgcattgaactgggaacgacgttggtagaacgtgaaagcaccaaatgaaatcatcgagtgttcgtgaaatttggcagaaatatcgtaattaattaatgtgccacccgattgttaaaaagtggtgcatgactttgatgggcactggttggtattgaatagcgcacgtgaatgggttgattggtcatgctactactttctgattagttggtctgttttgctaaggtgtgaggccataataacgacaattgtacccttcaagggtataattgtgagtgaggtgatgaaaatgaaaacaactgccacaatccttaaggagattcggcaacattaccaaattagtcaggcaaagctggcaaagttactcaacacatcggttagaacggtacagcactgggaacaagcggactaccaaccaagtggcaccgcggtacgtttgattcagattttggctacggacgatgcggtgtataccgcactgacaaacctcgaggaggagaatacgattatgtatttagaacacgatgatcagaagttcgccatcatgggtgtgcagtttcggaatcaagaggaataccgggcgaccatgaatgcaattatcagcaatatgtatgagggttttgagccgactaaggaagatgttcaagacgctcgtcgtttctatgacgaaggcccgattagcgcacaagagatgctagcaagaatacgtacttcgaccaatcgtaaagccgaatgagaaaggtatgggcggactacctacaaccaaacggtactttgaaaaatcgcttaggcattactgaagcggctactttgcagaaaaatgagtacaaagtgagtacgcaacggcaacagcaattatcccgcaatcactatcttctgccagactctcatcaattgacaggacgtcaaattggagagctaaaattgatcaatgggtttttgctcggtgaaatttacgactgggccggtcactatcgcgaagttgatttcaacaagaccgcgaatggcgtagtgacgttttttcacccggtggctttatttggtaatgctgagatagatattcaacgccaactcgataattttgcgctgttaccggatgaccgggaacaagttgcacaggcgttagggcaagttgtcaccgaaatcaacatgtttcatccgtttcgggaaggtaatggccgcacgacgcggctgtttactgaggttttggcttggcagcatggttttgacatcaactatacccaggcacagcaggatgcttacatgcaagcgttaattcaagatgatggcacaggtgttcctggaagtactaaccaaatagatcaattattgttagtcgtgatactaagaatggtcttaaagtaaaacaacaagtgcactcgggaatttctaatctgagtgcacttgttgttttagtttagtgagatatatgacgtttgttgcagcggtcaattttactgcttgagtgggccactaacttttcgtttatattcggatggggtggtctttaggtattttttaaacagacgaaagagtgatgaggtgttttgatatccgatgatgtcgcaaatgtcagcgagtgtacagttagtcttgatcatcaggttttgggcagcagaaattcggcggcggtcaacaagttctttaaaggtcttgcctgtcgcttcttttaatttgttacccagataattcgtattataagagaacttggcgctgacatcacgtaatgtcacgctggcgaaattctgattgatgtactgaatgattggcaaaagattgtcgtccgtattgtcagaaaagttaatgtattcttgctcaatcgattgcgataattcaagaattaatgtagatagcagcaggcccattgatttattacgttggcggctctttgtaaggcccttgataattaaactttcaactagattgatggcaacttcttggtgtgttaagtcaaacagaataaagttgttgtgcaacgtattgatgtgggatgcattatataaaaattgagtgatttcattggttgaaacggcaatatagtcgaaaagttggttcatcgttgagtcattcttgagcaagatgttaatcaaaatatcattactgcccgttgattcaatttgctgaacaatgtctttatccatcaaaattaggttgtgctgatgaagggtcactttttcgccattaatatactgagtacaagtgccagcatacatataattaagctcaataaagctatgcgtgtgagctggaacataggaaaagcgattatttttggtaacagcaatatcaccgtgcttaaaaaaatctgagcggggcatctggggaatcggattattcacataatctaagtccatgtagttaacgttaccatgtgattggcgttgctttagctcaaccggtgtcagagcaaataattcgtaattgagaaatttactagtcattaatactaaccttctttaatatttatcgtttagtggaacctgtgattttgcacgatcattcatgtagtcgagatatggtaccccttacagtaatcgcttacaatattcgtataaataaagggaggttcttcatatgaataacggcgagacgtcaacttcaatggtaaaaaaatatcggccattagcagtagctgcaggaattggttccattctaggatcaggaattatcgttggcttatccgcgactattacagtgtggcagaacggactaggacttactaacagtcaagttggtattatttcaggtgcactaacttttgcaattgcaattggatccttattagcaggacagataacaaaatcttttggtctagttaaatcgtttaattggttaaacctgatttatgcgattggcgccttgatctgtgttttctcgaataattatatcatgcttttgattggcgtcatcattaccgggttagcttcgggtgctgatttaccaattagtttaaccgtagtttcgcatgatgcaccggatgataagacctcggctagtttagtatcgtcgacgcaaatcttctggcaaattggggttttcatgtcttatgtttgtgcctttattgtttctaaaatggccggtgcttccggtgctcggattgttttttcgattttagcaatttttgccttgattacttgggcatggcggactttttcaactaagttccgagcatttcatgaagaaggtgaacaacggcgtattgatcgcgaagcagcttcacagacaacagagaaggtctcgattaagacggtcttcgctggtgccaacaagggacgctttatggcattcttcttcagtattttaatcttctatgtttgctggaatctactggccaatacgttcggacagtttcaaacgtttacgctggttcaagcacatgcgagtcaaagtttcgcaactggtgctgggatagtcctaaactttatctcgttgttggcaaccatggcttttgcatcagtcgctgggggtaagtatcgtaataagttcttcttagttgggattaccgttcaatttttggcaatgctcggactagcaatgagtagtcattcgttatggccaattgtcatcacgattggctgttacaacattgggaataatattgctggtgaagcgatgtataaagtttggacacaggaagcatttccagttgaagttcgggcatcagttcaaggatttattaatggcttttcacgggtatgttgtggcctatttgccttaattacacctgcgttagttgtgccatcagcaattcgtaacacgatgtttgggttcgctgccattgtctttattagctttgtagcagggctgacaatgatgcgattggaaaagaaacatggtattaataacttttaaacaaagtatttagaaagcgagtggaagagatggcgtttacttttcaaatcaataatgatgttcaatttcggcataatcaagcattattagacaagtcggcaagctatcggccaatactgaaagaaacccaagttaaggcggcatcgattgtggcgctcgagcgtgatacgcaataccttgaaggatggggtgttaaacaaattgcacctattgaacgattatcaagttatgagttgaaacgtgacgaccaaattatcatagattttggcgatcatcaggttggtcaatttagtattaatattaacgctgttggttcaccaatggatgcaccactatgttttaagattaagtttgctgaaatgcctgcagaattagcacgcaagagtgaagattacgacggttggttgagcaaatcttggattcaagaagaaactgttcacttagatgtgctgccaaccacgctgacgttaccacgacgctatagttttcgttatgctgagatcacagttgttgatacgtcaccaaaatggcgagctgtttttagcaatccagtggtcacggcgacaagtgcggtagacactgcgacagtgcatcaaccgaaattagccgatgcacaattacaacggatttatgaggttggcttgaaaacattagctgattgtatgcaggatgtctttgaagatggaccaaagcgcgatcggcgattatggattggtgatcttcggctacaagcattggccaattatgcaacgttcaaagatacagatctggtcaagcggtgtctgtatttgttcggtgcgatgcctacaacggctggccggattcctgccaatgtttttactaaaccaacggcagttccagatgacaccttcttgtttgattacagtctattctttatttcaattttggctgattatgaggcgtttagttctgataaaacagttttgaatgatttatatcgtgttgctaaaaatcaaatggatttggcgttggcacaagttacttctgaaggtaaattgaaattgactgaagaaaatccggttttcatcgactggtcaaatgattttgacaaagaaacggctgggcaggccattattatttatacgctaaaacaatttattacgcttgcggaactggttaatgatacaagcttagagacctatacagcgatactgcgtaaattaaaccagtacgctaaaactcaattgtttgattcgcaatcggggttatttgtctcaggggatcagcgtgaagttaatgtggcaagccaagtgtggatgacactagcacatgttttggatcctgagcaaaccacggcgcttatgcaaacgaccgtcacgaaactgtttccaattactggtattgcaacgccgtatatgtatcaccatattacggaagcattatttgaagcaggcttaaagcaagaggccgtccaattaatgaaagattactggggcaaaatgattacgctaggtgcggatacttattgggaagcatttgatcctaatcaacctgattattcgccgtatgggagtcccattttaaatagttattgtcatgcttggagctgtacaccggtgtacttgattaataagtacctcgtttaggaggagtgtctgcgatggttgacgaaaaagtaaagctgagtaaagcaaacgtactcttaataattgttgctggtctagcttcctatatggatgcagcgttgctcgttagtctgggagtagcgctacctatctggacaaaatatttagcactgaatagctggatggtcggactactaagtactatgctgacggtcgcggttgcaattggttcatttgtgggcggctggctgtcggataaatttggccgggtcgcggtgtttaatgctgatatcttttttgtcgcgattggctcgtttattattgcgattgcacaaaatacgacgatattgattattggtgttgtgattgctggtttggcctctggtgctgatttaccaacgtcattggcggttatttcggaacggatgtctagtaaagtttatggtcgggcaatttcttcaactcagattttttggacgatgggcattttgttgtcacagtttattggttttataactgctaacagtggtatgggaagcccggcagccttatttggttggattggattagtggcaattattaattggtgtgtgcgggtcttttcaaagcgttttaaacagattgaaacagacttagttgaccatgaacatgtggactgtgcatctaacggtcaatcggttaagaagtatcgattaggtcagctattgcgaacaggtggtttgttagtaccaatgattctactaactgttttttatctattttggaatttgccggccaatacgtgggggtcatttgttaactatttcttagtgactgttgatggccgtacgcaagcctattcgacaatcgtggcattaattgccaatatcgtgtgtctgttagttaacctgatctatttaaaggtttcagacactaggtatcgctaccgagtgatgtatttaggtattgccgtagcattgctttcctttgtgactgcagggatctttagtgatgactggcagattttcaccgttgtttatattttctattctggtagcacagtattatgtggtgaggccctttataaaatttggagtcagactttctatccagtggatgcacgggcaacgatgacgggtttttcttatggcttagttcgggtgctgaccgctgctttctcactagtaacgccaacattaatgggatattcgccgcaactcttattatggattatggttggatgtacggtgctattcggtgcctgtgcagtgatcattgtcgctattattaagaagaccggtttaaaagacccaatgatgaaagcggtttctgaataaattgattaatattactaagaattaaaaatgtaagccgggcattgtcgggcttatttatttaaaatcaaggaggataatgctcatgtcaaaagaggctgtttggttatggtatcctggtgattttgaaatccaccaagggatgttacaaaattttaaacgcgaagaacgtgggatgggttggcctgcctattggtatattgatgattgcaatcgtaatgttaattttaaacggcactatgatttaaaagaatccacacaatttacagtactcgccaaaggaacgggctatgttgatgttaatggcactaaatatcgcttaaatcatgcgattaattgtgatgcgggtgcgactgatattcaagtgtttgttggtaacgttcagggattgccgacaatttatattgttggtgagattatcaaatctgatagtggttggctagctagcaattttgtcaccacattacccgctggtcacgatattctctacactgaccgtaaccaggatcctaatgtgattgaatatcggacagaaaaagtagtggccaaagcacaacaagcagttgatggtggcgttttatatgattttggtcgcgctgtgaatggaactgtcacagtcaaaacgaatgggccagttacactatgttacggggagtccgaaactgaagcacgggatgttgagatgtgttattacaagcagtcggacgttacagctacaacaaaggttcgtaaacgtgcgtttcgatatgtctttgtgcctcattgtcagttaggtgacattgaattaactgctatgcacgaatatattcctaaaaataatccctccagttttacctctgataataagttgatcaatcaaatttggaatgtagcgacggaaacgttaaacctttgcagtgacttgttctttatcgatgggatcaaacgtgatcggtggatttgggctggtgacgcgtaccaagctaattttatcaatcaatattctttcttcaacgaagatattgataaacggacgttattagcgttgcgtgggcaagatgatattaagcaacatatgaatacaattgtcgactattccatgttgtgggtgattggtgttctaaatcattaccagatgacgggtgaccgtgaatttctcaaaattatttaccctaagttagagagtatggtgcaatactttattcaacagacaaatgagcatggttttatttatggtcggaaaaatgactggatctttgtcgattggtcagaaatggataaacagggtaccgtggcggctgaacaaatcttattacttgaagattacaagacaattatgacttgtggtgaggtcttaggcaaagatgtggcgggctaccaagcgaagtatgaccagttgtttaagaacttaatgaaatacttttgggatgatgaacaaggagcatttattgatagttatgaatcgggtaagcggcacgttactcgtcatgctaatatttttgccattttgtttgacgttgttgatgagaacaaacaacaattaattttaaagaatgttttgttgaataatgcgattactcaaattaccacgccgtattttaagttttttgaacaagatgctttatgtaagctgggggaacaacaccgtgtttaccaagttttattagactattggggcggcatgttagatcgcggggccgtgaccttctgggaagaattcgatccgtcgcagcatggcaaggatatgtatgccatgtatggtgatccctatggtaagagcctgtgccatgcctggggagccagtccgatatatttattaggtcgtcattttgtaggattacggcccacggctccaggataccagacttttgagatcaagcctgagttatcagaatttcatcatttacacaccgtgttacccattaaaggcggtaccgtgactgtcgtaaaagatcaacaccaactatcagtcactgctagccgagctggtgggacattgattgtggatgggcaaagacaatctttggaacctaatagaactgcggtggtcccagtgtagccgtcattattttaatgggttaatttagaagacacttttggtatgcgcttgttgaagcaagtgcataccaaaagtgtctttgatttgtgtcaaactatgatttattcgtcggcttcacaaaacttttccgataaattaatttagcatcaactaataccatgcgcttctgtgaacggtcaaaaataatcgtatctttcaatgttgtgatagcctgtgcggctaagtcgtctgtgtcaatgtggaaagtcgtcaatggtggtgaaacgtagcgcgcaatgtcgatatcgttaatactaataattgcggtatcagtggggactgtgattttgttttcattgaaagcctgtaagacacccacggccaacggatctgaaccgactaagaaccctttgggcaatgcttgtttactcaacgattgcacgacttgttgtcccaagcgatagccacttgcaacggagaattcaccaccaatgaatagaaaccgcgaatcaaatagttgtaactcgcgtagccgactttcaaagtatttttggcgcggatcttgttgatgggtgacttgttgatctttattccagtagccgccgttaatgagaccaatgggcgtatcacctgcggctatcaattgatcgatggcttgttcggtaattgcttggaggttaggctgtacagaattgaagtgatgcgggtctggattggaatcaacgaagattctgtggggtgttagctggcgcaatttatggagcgcatcagaatcgaattcgccaactgccatcacaccgtcgatgtcgtggggaatgtggtcgatatccggataaaaggtgagctttaaattagcctgttttccgtgttcaacgagactctgacgcaaattactgaaataaatatcttcaagttcttgttttggttggacagcgaagattgtagctatctgataggcaaggccgtgagtggtgtttggttgttcgtaattcaagttttgagcagtttgtagtatttttttgcgagcgtgatccgagattgaaaatgacggatcattattcaacagccgtgagacggttgccggtgaatagcccgctttagcggcaatttcacgaatagtcggcacagtggaagactcctttcgacaaacaagttgctaaacagatgattaccagagttaaaaagcttcacttataataatacgctttcattagcgctaataaaagcagtaatgaatataaacaaaacgtaaatagtgtttaccgatatttagtaattattttagtaaaacgggttacattcacaaatgaaagcgcttatcataagagctgttaaagcgtaattaagttgatagaagtgagggtgcgtttgaatgtccaatccattaaagacaacagaatttttgcatggtggtgattataatccagaccagtggcttgacaaacccgaggtgattaagcaggattttaaagcgtttaaggctgctaagttaaatacggtgacattgggaatctttgcttgggacaagttagaacctgctgaggggcagtatgattttagctggttagatcaaattttcgatcgtgccgaagcccaagggactaagatcattttgtcgacgccaagcggggctcgtccacgctggttagctgagaaatatccagaagtgttacgtgtcaatgaacacggacagcgaaatcaattcggcgagcgacataatcactgttacacatcgccagtttaccgagaaaaggttcagatgattaaccagaagttggcggaacgttacggtcaacgaccaagcttgctgctatggcatatctctaatgaatatggcggtgcttgttactgtgatttgtgccagcaagcctttcgtcattgggttcaaaaaaagtatcaaacgttagccaatttgaaccatgcttactgtggtgctttttggagtcacgattatacaagttgggatcaggttcaggcaccgtcgccgctgggtgatacgaatgtaatgggacttaacctggattggcatcgttttgtaacagaccggacgattgacttttttgataatgaaattaaaccgttacgagcgctgacacctaatatccctgtgacagccaattttatgggtggcaacccatcagaatcacacgtcttttatgatttagattatcagaagtttgcgaagcatgtcgatattgtgagttgggattcatatcctaattggagtaatggttacgaaagtacggcccacttggccatgaaaactgctttgatgaatgacgtgatgcggagcctcaagcatgataactacttgattatggaaagtacaccgtcacaggttaattggcacccatataatcgtgccaaacgaccaggcatgcacgaaatggggagcttgcaacaggttgcccatggtgccgactcagttttgtatttccaactacatcaatcattaggagcttctgaaatgtttcatggcgccgtcattgccaaccatcgtggctcaaatacgcgggcatttaaggacgttcaaaaagttggtcaggacttacaaagcttacaggccgcgcatggaacgaccagaactgcagctaaagtcgctattgtttttgattatgacaacatgtgggggttagatgatgcccgcaactacgctaacgaaactaaaaagtattggcgcacgattcaagaacattaccagtatttctggaaacatgatattccagttgaaattattgcgactactgatgatttgacggcctatgatttggtgattgatccgatgcacttcatgatgagcgcccagtttgcgactaagcttaaagcatatgtgcaacagggcggccatctgatcggcacctatattacgggcgtcgttgatcatgacttcttagcctatcaaggtgatgggttagctgacttagaagcaacttacggaattaaagttcaggaaactgacacattatatccgcaacaacataatgcactgactgcttatcaccaagcgtatcaagtgaatgattattgtgatgtagttgagacgacaacggcacaagtcctcggcacgtatcaaaaagacttttatgctggaacaccggctgtaacggtcaatcaattgggccagggagcggcgtattatttggctgcgcggaccgatactgacttcttggatgctttctatgaacggcttgccacaagtttggcacttaaaccggccttgccagtgatcaaagcgaatgccaaggtaagtattcaagttagagagaatgcgacgacgcgctattacttcgtgatcaattttagtcatcgaccaacgacggtgacacttgaagtgccgttacggcagatttttgagaatcaagtggtcagtggcaagcaagacttggccagctatggtgttcaagtctatatgatgaataaataattaagtggggtgaaattaatggcacaaaatgttgaacaacaaccagtaaccaagaaaaagttatcatggcatcaaattaatgaaggtgttgcctttggattaggtaacttaggacactcggcattctatggtgcgttgagtacctattttattgtctttgtcactagtgggatgtttagcggcgttgcaccagctatcgccaatcggttgattggtttaatcacaggactggtggtggtgattcgtttagcggaagtcgttgtcgatccaatcttaggcaatattgttgataatacggaaacacgttggggtaagtttaagccttggcaagtcattgggagtattatcagttcggtcttattagtcgttattttctcaggaatctttggattagcaaaggtaaactggattttatttgcaattgtttttgtgattttatttattatcttggatgtcttctattcgttaacagatgtctcgtattggggcatggttccagcgattagtgaagatagtcatgcccggggaattttcacggctcttggcagttttactgggacgatcggttggaacggcctgacaatggtcgttgtaccaattaccacgtactttacctttatcgcaactggtaagcatacccaaggtccacaaggctggctagcgtttgccgttattgtcggtattgtggcagtcatttccgcactatttgtcgcctttggaaccagtgagaagcacaatgcgattcgggaagcagccaaacaaaagacgacgatcaaaggtgtctttatgggcattatcaagaatgaccaaattatgtgggtcagtctgggttacttattctattcattagcatacgtgacaaccaacggggttctattctatctttttaaattcgtgattggtaaacctggtgaattttggattgctggggcggtcgcaactgtgatcggttttgtgacgtcaccactatatccaatcttgaaccggtttattccacggaaagtgctctttgcactcggtcaatgctcaatgattttagcctatattatctttattgttgcgcagacgaatttgaccttattgatcatcggattagtccttttcaatattaactttgcccaattagtcacggtcctatcaatgaccgatgccattgaatacggtcaattgaagaatggcaatcgtaatgaagcggtggtgcttgccgttcggccgatgctcgacaaaattactggtgccttttccaacggtatcgtcggtgccattgctttagttgctggtatgactggtagtgcaacggccgccgatatgactgcaagtaatattcatacgtttgaactcttagcgttttacttgccgttagcatgtgcaatcttgtcattgttagtctttacattcaaagtaaccattaccgaaaagaaacatgccgaaattgttgaagagttacaggccaaattggcaacaggggaagcagcggatgttgcggtaacgcctgcatctgacattctgaccactgaaatcttagcaccagtaagcggtcaaccgctcgcattagcggatgtcaaaagtgccgcacagccacaaggcttaccgggagttggtttcgccatcaggccaagtgatggtcgcctctatgcgccattcgatgggacgattcggtttacgttctcaactaaacatacgttaggaatcgtgtcagctgacggtcttgaaacaattattcacgtgggaatcgggacggttaacctccgtggtgctggctttacgacttattatcaagatgggcaagtcgtacacgctggtgatttactgatgacctttgatcgtgatctgatcaaacagagtggttatgacgatgtggttgttactttctttacgcaacctggtcgcgttacagcacacactgaagattggtcaacagaagtacagcatggtcaatcagcaatgaaagtaacattcaaatagattggagttgtcggtcatgacaacgccgactcattgcgataattgttcgtgttagacttgaggtatcaaataagcactgctcacaaaatagtgggcagtgcttatttggcattcattaaattgtttaacaagtacggtacgggttagcgtttcatcggtacttccatgccagtgctggtctttgcccgctgtaacaacaagtagtgggccgtgccaaagacggcaccaactagcgcagggactaaccaatccattccgctgctggcaagtggtaagaagctttggacatgcgccattgcttggccgaaagtactttggctaacaacggcggggaaagcggcaaccatatcaaagacggcggggacgacggtgaagacgacgacccaaacatagacgacacttgacttgtggaagagtggcgaaaggatcgataagaagattagtgccatggctaacgggtaaaggaacatcaggacgggggtggaccaggcaatgatctgatttaatcccacattagcagttaaaaatgaggcgaggcacgtgattcttaaccaggctttgtaactcaagaaaccgaagtgcttatggaagtcctgagcgaaggcggcgacgagcccgatagcggtggtcaaacaagtggtaatgatcaacacggctaaaatggcttgtccgacattacccatgtagtggttaacgatttggtcaaaggcgaccccgccgttatcggataatttgaattgacctaacgattgcgcgcctaacaagattaagagcacgtaaatcaagccttcaaaggccattgagaagaagccagctcgggcggtcacccacgcggctttgttcgggtcggtttggcccatgaaattaacggcagtgacgatagtgacacctaacgccaacccagctaaggcgtccatcgtgttgtagccttgcaagaaaccattggtaaagcctgcggtctgataggcagcagttgcactggtgctaccggcatgagctagcggactgctgaaagctacggcgaagatggcgactaataatagcaaaaataatggatttaataatttgccgacccgagccataattttgctctgttcaacggacaagtagtaggcgagtccgaaaaatgcggcggaaaacagcagtaatgcgagtgattgatactttgctgggaaaaacggtgccagaccaacggtgaatgatacggtggccgtccgtggtgttccaaagaaggggccaattgtaaagtgtatgagaaccatgaagacaacggcaaaggttgcgcctagtggtttaccaatgtcataaacgcccttggatttagtgacacagacggctaaaacagatagtaagggcaataaaaccgccgtgatgagaaagccagccgcagcaatcccccagtgaccgcccgctagctgacccaagtgaagtggaaaaatgaggttgccagccccgaagaataaggcgaaaatcattgaacttaaggtgacgtaatcacgtttggttaagtttcgcttttgaactcgatttaacatatcaacagcactcccttatttgattgagacaataatcattaaataaaagttgcgattaaccaaaaaacgtcctgatatctgagttagactcagaaaccaggacgtttgaacacgtgttaccaccttagctttgtgactgccttacgacgaatcaccttaaaaagtacggcaagtggccggccacttgcgatacttcggctcaataatgggagcaaccaacagcaactaacatcaagctcgtcactgccactcagaactgattttcaacgatctggtcatgatgtcattgcaccaaactgacactctctaggcatttccagaaggtttactttgttcatcggcgtgtttgttaatcgatttttaatgtggttctaatttacaaccgcgattagtatttgtcaatcttttttcaaaaaaagttagttagctagtgcggattcttaaataaagatggataatagctgtaataaggaaatttgtgaggagggtccgctgatgaccaacaacaatgaggaaaggccccaatggcaagtgaatcagaaccgccatacccgttttcggacgattgtcagtgtcttgcggcgctataacgttttgagcaaccttgcacgtcagaaaaatcctgatcaagtgcgcgcggcgtttgaagaacttggaccgacgtttattaaaattggccagattctttcttcacgtacagatatcgttaagccagaatttgctaacgaattcaagaaattgcaaaataatgtccgggccgatgattttagtgtggtcaagcaaacgatcgagcagcagacagggaagccaatcaatgaaatgtttgcccagtttgacgagcgaccgtttgcatcagcatcaatgggccagacgcaccatgcgacgctgctcaatgggcagaaggtcgtggtgaaggtgcagcatccgggtattgacgccgaggtggccctagatatttcattatttgagcgggcgttacccctattgcgatatattccggaatcttcagttgttgatttgcgtgaaatggttggtgaaatcaaacggtcactattcaatgaattggataccagtattgaggtaaaaaatggattacggttttaccgattgaataatgcggacgatattattcgggtaccccgggtttatgcgaagtatagtacgcaaaaagtgcttgttaaccagtatatgccgggaacgacgattcagcattttatggcgcaaatgcttgcggccgatgaagacggaaatcaccagtatgatgacgaacgccgctatttggcccatgtcttggtgcaaaatttcttgaagcaggtttttgaagatggcttttttcacgctgatcctcatccagggaatatcttattgcgggaattgcaaccagatgatattgggtatcacgatacggttcccaagcatggcgggaaaattggcaaacggcagttaccaccataccggttagtttatctggattttggcatgatgggtgagatcagtccagctttgatggcaggaattgctaatgttgtcgtggcagtgacaaccgaagatacccatcaagtcggcaaagcaatcttagcgatttcaaaccgaactggcgtggttgatgaagaagcgttctttagtgagttagcaccatttttaagtcagtattataattcgggactgggcgacattgattttcaaggcttgttgtttgaaatggtcaaggtttgtcgcagtaataatattcaaatgaatccagcggttaccatgttaggtaaggcgtttggaacgatcgaaggtattgtggagacgctcgacccaaccttatcaatgatggacgtggcgcggccgtttgcgcgcaagtacatccgcgagaattttaattggcgcaatgaactggaagatggcatgttggctagccttcaaagcctgcgtgatgccccgaagattccgtcacgcttattatcagctctagatacgtttgagaatggtcagacgcgggtcaacttggtctttgcacaccgcaagatgtttattgatcggattgattcgatggtcaataagattgtactgtccgttattctggcagcgctgattgttggatcatcactactagttcaaagccatcctgataatagttggattacaaacattggtatttttggctatgtttcagcagttgtcgtcattattggcctattgattggaacgctccattcctggtacacgcattggcgacgcaagtaaaacttggcgtagggttaggctatagggccatgcgtcatgagaagttggcaacgtagattcgtctaattgagactgcctaaaatataagcatacgaaaaacagcggtaccgtgatgattccaagccataaaatcatcacggtaccgctgttttattaatcatgtttcagtatcaaattgatcgtggttaatggtacgactgtcaattgctaactagtcttctgatcccataacccgagcacagaatgcggccaagatggcgccgacttctggtgctaagatgtagacccatagatgtgataaggcgctaccaccagcaaaaatagcggggccgattgaacgggcagggttcaaagaaccgcccgttaagttgagagcgacaataatcaagaatgctaaggtcaccccaatggtcaaaccagcaaagtctgcgttaccatggtcattactagtaacgttcagaataaccattaagaataagaatgtgactagtgcttctacaaagaaggccataccactgccgatttttggaaaatcggtttgaccaagcgatgttgcggataagcctaatgcactgacaaacgacttaactgctgcggaagcaacgatggccccaatgatttgggcgatgatatagccaatggcatcggcggcatcgattcgacggttgattaacatcgcagtcgtaacggcggggttaaagtgaccaccagaaataccaccaaaggcataggccgaaacggtaatcgctaacccgaaggctaacccaatagcgaggacgtcacccttagcaatcacaacggttgcagtccctaagaaaactaacataaatgtgccgagaaattcggcgagatacttgcgcatagttgcacactccctttttgaataattgctaacttaacctattttacaatacctgctcgtgaaaacgacggaatttgtttgatttgtgaatatttctgataagatttttataattatattaatggataagatactggtaaaacgttggtataaaaacgttttatggcagttgtggattgttaaaactataataaataaaaattttatttttgcatagtcactattgatagtggtcagtatgattggtgtgtgacctaacgtgactgtgaacgctaattgtcgataatggtggcttctgttttataatggttaggacaagtaagctgatgtttttgaaaacgaattaaatttgtttcacgtggaacagtaaaggaaggtttaattaatggcgttatcatatcaagctctattaacagcagttccggtcgttttaaaagcggggaacgtaccgaacattgtcggtgaagccgggattggaaagtcggccttggtagccgaggttgctaagcggatgggggcgcaattatacacgaccgttgtgagcctgtccgaaaagggggatttagcgatcccagtcccaccactaacgagcgactcatttattcaaacgaagcgctatggccagttggctgacgtacaattcggctatgcacacacgttaattgaaattattcagtatgctgagcagcatcctcagcagccaattttatggtttttagacgaatttaatcgtgggacgcaggctgttcaaagtgaattgatgaatctggtcttgcaacggacgattaacacattgaaattgccagaacaggtgcaattgatcattgctgaaaatccagatgctagtatgactggattcgaaagtagtacgtatggcgttactgccggcgatgcggccatcaaagatcgtaccgtgcgtctagttatgcgagcagatgcggcagactggcttgcttgggccaaacaagtggatgagcgcatgaaccgaccaaacattcatccactcgtccagcagtttattagtgaagatgtaacgcggcttaatcaggctgatgtccaggctgatttaacagcgacgccacgtgcgtgggcgcgtgtttcggctaatttatatgagattgaaaaacttcctgtgcatcaacaaacggctgtggcactggatatctttcaaggagatgtgggtactgagctagggcttgtattcgagcaattcttggaacaacaagccattcatctgacaccagcgatgatttatgacagtcaaccagtgggggccgtggtgccggcaccgattcttaagcagtttacggcgatgaatgaaattcaaaagcgaacggttttggcaagctgtttggctctaacaactacgtatccgttgacggacgatcagcacgctggtcggttcatgcaactcctacaaacactcagtcaagatggtcagtttgcattggttcaacaaatcggccatgaacgcgacttattaaagcaattatatacagcaaatgttgccaagcaaagtccgtatgtgaccgctttgtatcagtatttacaacaggtcgccagttggtcaaatcagtaagaaagcagtgagtcatcatgattaacaatgccaatgagtacacacgttggcaacaagcgatgttagtgacgccaacagcagacacgatccaggcaggtgcgaccatgattgatcgggccattattgagttactagccaccgatcaattttatggcgagttgctgacccgacttcccagacagttaaatacgacgttaacgacgccgtttatcttagcttggcagaataatcagttggtcttacaatatgcgccaacagtaattgctcgagctttttcacagttttcttacttacaagcggggttaaaacacgtggcactacacattgtctggcaacaccccgttcggtatcgtgatcaggtcaagcagcagccggagttagtgacgttggcgaccgacctggccgttaaccagtatgtcgacggtctgcctaaagatgcggtcagtttaacgactgtccagccgttagtcgatgcccagctaccgcgacgagcagattctggctgttatttgaaattattacagcagcagtcgcggtcgcaacttcagccgaatggcgcgcccaccgccacttcgcgaaataaggaccagcggcagccagcaaaagggtctggcgaccaaaagtcgcaacagttgatcgatgatccaagtggctggtcagcctctgaacagttaacgaatcccaatttggcaactgcccgtttaaaacagttggcgaaagatgcttggcagcaaacaaatgaagctggccgagggttagtggccggcaatgttcgagctcagctcactgtaatgacgcagccggcccagcttgattggcgacaattactagttcggggcctgggtcagattccgagcggtactaaggcctcgcacgcgcgctttaatcgacggcaacccgcgcggatggaaatacccggtcaaattggcgatacgcgcttggacttgcaagtttatgttgataattcaggttctatcagtgatctgatgttgcaacgattactggcacaggtggctactttaacccgattatttgcagcaaccatcaccgttaagccgtttgatgcaatcgtacagcctggtcaaacgtatcaggtgagtttgccacagcagattcgctttacgcgccgtggcggtggtggaaccgtttatcaaagtatttttgatgatttactaacacatcataagacgaatgcgacgaccttggcgctgatcttaacggatggccgtggtgaacggcacgttgagtcacaccgttttacaaatgtgatttggttgttagcgcgggctgaagatcgattgtcgattgagccagcaatcggtcatgtagttaatttgaacttggaggatgaataatatggggacaccacttaatccagatgatatgcaatccttgttaacccatgaccgtcgttatcagcgggccagtgccatcttaacggatcagtggcaacgaatcatagccgatgaagatttggcttaccgacaacagattacgattgacgatttacagtttgctaaggcgttgctagctagtgagacgctgacaagtcaatttgaatttgaccattacgcgggtgtgcaacggttgcgacaacattatggtagtcaattgacgagctcagcacagcactggttagtgcaaaaatatttataagtcaatcgctagttatgacccaaaagtatgactgtgacttatatatagatgaaaaaataaagcaagcttttcccaaaatgttcgggagaagcttgcttattttatgcgctgattaactgctttaggttcaacgacgtgctagaaaagccatccaggcttgttgctgcgcttgaatatctggctgactgccttgacggagtcgcgtttgaaggccgatgcgggcttctagcagtgcctgagctaatgtcatactggactgattattgataatttgctcgttagcttgacctttgaggatgaccgcagccatgagggtcaggtagtcgtcataaaaccagctgacggcttgctgaacatcagtatcagtagtaccaaattcagcgacggcgttagccattaggtcaccggctggttgttcggatgtcgttaaatcgtggctaaagagcatactcaggatagctaagggggcggcaccatcctgctctaagcgttgcattgcttgggtacaacgcattaaagtttgctggtgatagcgctggagtgcacgcaggtaaagtgtgtgcttgtccccgatagcgttatataaactttgcttcttgacgccactagttattacgatttcgtccatggaagtatgataatagccttgctgccaaaataagtgcatgattttttcgataacttgatcgtcttgaaatgtctttttagcgggcatgattcgaaccgcctttctggttaaaaataagtgttttaagtataccacagcacacttcattgtttggtaaatgaatattaacgtttgaaattatttgattagggggcttttactgtttttaaagccgattttaattagttgattgtgttgcactttaaaattgataaaagttttccacattaaatcgattacataattttataaattgaagataatttatgtaatagcttgctgttacaacgatattctaaatatatataggatttcaatatttataattatcaaaatttttaacttatgtgtggcctcatcaaagtctaacgataatataatgttgacggcttgtttagttgaacacgccaactagttggacctaatcggataaatgaaagcagtaggaaagcttgccgttaaactgattgcagtagtttatattaaaatatttgtaatcactataatattaaaaatggctcagaagtccgttaaaataggaattttaatcaatagttaaggggcgtcatcaattgacagcgattccaaaaccatgatatattttcgttgctgatagggttactcacaacgattcactattggtactaagcgttaataatgatactaagcttaagtcaatatctggaaaggatgtggtcatattaattggatgggcagctttcaagacttaggtattagtcagctagtcaagttaccactagtagctgatacgcaatcaggcacttaccacttaacgatcacttctaattcaggtggcaatgcggcggccaataaaattgcgagcccgctacaaggtgtattaccgcaaatgaatgggacccagcaatggattctgttcggtatcggcgtatgtggacttagtttattaatattattaattctaatctggtggcgcaaccgtcaaacaataaaggagcaaccaaaatgaaaaaatatctcggaactctcgttgcaggcatgacactaatggcaggattaccacttgttggccaagctgcagatacggagacaacgaccaaagctgaagttgaattaatccaggatgacactaataaagatattaccttggatcaagcacctggtgttagctttgggaccgaaaaaatcactaatgacagtaaaacctatgatgctaagaacgttactggcgacttgaaagtgaccaaccctgggaatacggacggatggttagtacaagttaaaggttcgaagttcatgaatgcagatgatactcgtgaattacggggcgccgcgttaacttttgcacaagttaatgcaactgcggatgatgctaataacatctctaaagcaaaagcttataaagtggatatcactgaccaaaatcaaattatcatggacgcagaagctaatgaagggatcggtaagtttacgagtaagtatgcaaccaatgaagttagcctgttgatccctgctggtaacgcggctggcgcttacacttcaaccttgacatggacattaggcaacgcccctagctaaccagttaatgcgccagaggagaactgaggtgtgaccgatgaaaaagggattgttggtaacaggtcggttattaatgactgtgataggttgtctcatcattagtaactggggctggtttatcgcaacgcaagctgcaacgacacagtcacaggtgcaggtagaaatgaccccctcggatgatgacaatgcagtttctccggtcgaccctgatgatcccagtaaaccatacccgggtgacccggtcgatgaagacaatgtcgctggtacgggctcacggggaaagttaaccattgatttcgtcagtaatttgaaattcaatgcaattacgaccgcgggtgggccgtttaagacgactgccaagaatgagcgggcgatgattcaaataactgatcgccgcgccacggctgctggatggacgttacaggtcacgccaagcgggttgcaaagtggtcagcagaccttaacgacgtctttaaaattaggcgcagtccaattacggccaggtgctggcaatgttagtactgcacctaacgttgttaatactggtgaattagttgctggtttagcgaataatgtcgtgattgccccgcctaatactggtctaggtacttggctggtcgttctgaatcgcgggcaggtacccacggaacttgaagtccatgatcgccaattgcgtgctggcgactacacgggtacgctggcttggtcattaacgaacgcacctagttaattaaatggtttgatgtgaagctgctacttgtaaagaatggcagcttcaatcatacatagctcgtcacttaccgttgaataaaggaagggtaaagcctatgaaaaaaatattttggcagttaattgccgttgtgagcatcgttatggcaggtttgacaatgactgctagagcggatgacctcaattacacggtccaggctgatttgcctgataaccaaattaatcaaaaagtgtcctattttgacttgaaggtcacaccagggcaaacgcaaaatctcactttaaccattaaaaatagtgatagtaaagaacatcgatacacggtatcacctaatctggcggttacaaataataacggtatcatcgattacagccaagcaaaggctaaggccgatgactccttgaagtttaacatcaagacagcactttcaaagtcacaggtcgtgaccgttcccgctaagtcaagcaaaaaagtcactattaaattgacggtacccgagaaaaagtttgcgggcgtggcgctgggtggaatcaatatcatccaggaactcagtaccaaggcgaaacaatctagtagtggcatggccatcaataatcaatatgcgtacgtgattggcttgcagttacgtgaatctgatccaagcgggatcaaacctgtgatgaagttgcacgcggtaaaagccaagcaacgtaactatcgtaattacgttacggctaatctgcaaaacaaccagcccgttattatgcatggcttaaagatcaaaagctacgtgactaaagctggttcgtctaaaaaattattgacgacgactaaggaaaacatgtcaatggcgccgaatagtaattttgactttgcagttggtgacgggacgcaacaattgaaggcgggcaagtacactttacatttaacggcaacggctgataagggtaagtggcaatttacaaagaactttaccattactgataaagaagctcagactttaaatgatacagctgttacagaaaaacaatcgaactatttctggtggtttgttgcgttgggcgcactgattgttgtcctattaggcgcaattatctggctactattgaaaaaccgccgtcgtcaggactaactagcgagaggagttttcaacatgtggaagggaccgaaacaaatactagttgcattaactgcattaatgggattatgggccgggaccgcccaaattcaggctgctgacgaagcgacgttggcaacggcaccgtctggcctgaatcagttggataaactctttacgctaccagcggcattcagtagtggcattagtaatagtgcgaatattgggaatgtgaccaatgcaagctcgccaaatacgcaggccgttcaggttattaacggcaagaagcaagtgggtggcttttggtcgaacgacgccaatcgcctagatttaaataaagatgctacgtttaaaatgtgggtgtatttgggaacatccacgagtactagtaaggccggcgatgggatggcttttgtcttacaaaatgatccaaatggtactgccgcatccgcacaagtcagttcgtccagcattattggtgagacactcggtgtttggggtgttgatacggataataaattgaaggacggcgaagaatttgcgaaaacggccatccaaaatagttgggccttagagtttgatacctataccaatacttcaactagctatagtaatgctggtaagggtgattcgtttgatgatggtattaagaaacaacacattgcgaccgggtatcctgggctggctagtcagtatgaaaatcagtctgtcaggagtttagacgttaccgggataatttggtcaacccggtactactttacgcaaaaacataccaacctagtgacgaatatgtcattaggagatagcaagtggcaccacctggtgatggactggcatgcggcgactaaaacgatgacgtacacttataatgacatcaatccagatgggtcggtgacgggtagcggctttactcagagtgaagtgttagatactagccaattcaacagtagtgatggcctggttcgctggggattcatgggggcgactggtagtaattctggtaataacatggtcgtgattgaaagcgcgccgaatttagttgacgtacaggcggcggttaaggttatggataagaccaagaatcgtgaaatcaagacaggcggccagctcaaagctcagcataaagttcagtacgactatcaattgacttaccaaggtggtcaaattgactgggataacattacggctgaactcaatctaccacagcatattacgtttgacagtgccaaggtaacgtatgcggatggtagtgagcagactttgacggcgccaacgagtagtgatactaaagttgactatactctagataaagcagtatcggctagtcaaccgaccgcgacgatcacgctcaatgggacggccgagaatgtcgttgtcaatgaacagacaactgcaacgacggcgacatttaaaaataaggtgtttgaaacaacgacggaagcaccggattatatgattacagtcgatcagccgctataccttaaaattcgtaatagtccgtatactgtcgccaatggggaagacgtgatcatcagagggattgttgcagccgaggattcggaacaattaactaacggtcaagtgacactacacccaacgcttaatggcaaggaaatgccaacggttcaaatgtcggatgatgacgaacaaggttacttctactacaaggtcaaagcagaggatttacacgtcggtgatgacaatgagattgaactatgggcatctgaccgttacgagaacgtctcaccagttgataaagcgcagattattgttactgcaggtgaacttggttttaagacggttgccaaaagcagcacgtttaaaaccattactttagatggttcggctcaaacgacagaccgggaagacgattggcaactagttgtacgggatagtcgtggtaagggctctagttggcaactacaagctagtgcgactaattttaaaacaaccggtggtcagaatttggcgggcgacgtgattttccgcgacggcgagcagacgaccacgctgaattctgcgggtacggtgattgacagtcacacggctactagtgataacgatgattatgatgtcttggcagactggacgaataagtcaggcattttatatcaaagcaatgcgggagctactccgggttcttacacgggggatattacgtggacgttaacagatgcacctaagtaatgatcgggttggtataagagaatcaaaagcactcacacgcaagattgtgagtgcttttgctttctagttattagccataatggttaaagataataataattttaattaccacagttaagtgaatgaataatcagcctgaatgactgagaacgttgtaatcaaggcatttgtttatcgtgtgattagtgaagtatttacactttttacgtgtttttggttgcgttttctttttactttagtacaatgtaattgttaccaaatacatgttgcacaagcatgattgtgaatataaacacatttaaggagcgatttaaaaatgaaagttattgtaattggttgtacccatgccggcactgctgccgttaatcagattttagcatcaaatccagatactgaagtgacgatttatgaaagaaatgacaatgtctcgttcctatcctgtgggatcgcactttaccttggcggccaagttgctgatcctcaaggcctattttattccagtcctgaacagttagctaagttaggcgcaactgttcatatgcaacatgatgtgacggatgtgaatactgacaaacatgaaattacggttactgacttaaagactggtgaatctaagactgatcactatgacaagttagttgtcactactggttcatggcctgttattccaccaattgacggcatcgatagtcccaatgtctacttatgcaagaactggacgcacgctcagaatttatgggaagcagccaaaccagctaagcgggtcattgtgatcggtggcggttatatcggtactgaattagttgaagcttaccagaagcaaggtaaggaagtcacactaattgatggtttaccacggattttaaataaatacttagacaaagaattcactgaccgggttgaacaagactttgttgatcacggtatcaagatggctttgaatcaaatggtgcaaggcttcagtgatgatggtaaagaagttacggtcaagactgacaagggcagctacacagccgacatggcgattctttgtgttggcttccggccaaataccggcttactcaagggcaaggtcgatatgaacgctaatggctcgatcaagaccaatgactacatgcaaacttctgatccagacatttacggggctggtgactcggttgctgttcactataacccaactaagaaagatgcttatatcccattagcaacgaatgcggttcgccaaggaaccttagttggtttgaacatcttcaagccaacgcggaagtacatggggacacaatcaacttctgggttaatgttgttcggccaaaccatcgtttcatctgggatgaccctagaacatgcacaggccgaaaatgttccggcagccgctgtcacttttgaagacaactaccggccagaatttatgccaaccactaagcctgttttaatgcaattggtttacaatcctgaaactcgcgaaatcctaggtgcacaattcatgagtgaacatgatgtttcgcaatcagccaatgtgatttcagtgatgattcaaaatcacaataccattgacgacttagggttcgtagatatgttcttccaaccaatttacgaccggccatttaactatttgaacttacttggtcaagcagcgattgcccatgcggccgaagctgtcactgaataataagttaaaataacgcgatgcttaccttgcttcatgaaggtagcatcgcgttatttgtttattggtgataattgaatgttaagtggtcggtggtactaaagttaaggccagccagtatttgtgccattaggtcatcgtgctttggtaaaatcaatgtgagtcggttcaactttaactcaacggtaccaaatgccaccaaccgttctaagatttccctgagcgtagttacttgctgataagtagcagtcaggtcaacactgagagttgcttcatgcttagccgtatcgattggggcaaagccgacctgaccgacgaacgcattcgtgtctcgatccgttacgccccaaacaagctggtggtcatgaaaaatctcgcgcatggtgtggttaatttgtgcagcggttgtttccatagtggctgtcgcgttgctggtctgatataagttgaaaacgtcgataacgcgcacctttgttaaccaatcgaacgtatagtgtggcgttagaatgggatgatacttttcaaattgtgacatagtgcctcctttaaaatgcgtcatgaatatttagtaattcctattgtactagttaaactgttatgaatcatgattaaaacgtgccattttttgagttcaaaatcagccagtttaggttcgctggaaacagttcgagttagcgtaaacttgcttagttagttcgtcctacgccgacttccaggcatttctgccaattgctggaacgcagtggacacagatttaagccgaagaccacgtcttaaatactggtcttccactaaccaagccaaggacgcttgctaagtggaatttcaccgctgagcattggccgaaacgccttccagtcgggacagtattcgaatggcggacatgtgcgtactcagtttttgatggctttgtcgttgtttcttataaacggtaattttgtcaatcaactgttaggctaaaaatgatattgtgatagctcgttattctgaatcgccgtagtaacaactgaacgttttggcaaagtgaagaaggcactctgatatttcacctaaagttccaatatcaaaatagccaacgacaaattgtaccaagttaagtggctgttcatctgccattcgagcggcttaccgaccggaggggttgggtgacaatgctcagtagccaaattattcttagtcggaagtgggttgcttccggcttagaataagactcgtatttgagatgacgcgggctgggcgttagctcaaatcgacgtcggcttacgttccagcaattgtcacccagccccggaggtcggaataggacactcaccggctgacgaacagtaagccaactaaatggcacgttttaatcatagttaatgctagttgttttcgatggttaccagtgtccaaatatgctgatttaagcgtcaagtggactgggattgccttgttgatgaccctcgctgaaaatggcgttaggtcgactaataacgcgtctgctggtgtgatttgcggtgcagtcgtgattgagactgggtcacagtccaataacgatgtaacggcatcagacgacagttctattgtaatatactaacgcgtaatttgaatgaataagacccataatgatggaacagataaaagaccgactaacaagcaatcgcaccgcttgttagtcggtcttagtgttcattgattaaagctttttaccagattttgacccgcttatctggtgccaaatacatggcatcatcgggttgaatgtcgaaggttgtgtagaaatcatctaagttcttaggttgtacgtttgctcggagcttagctggagcgtggacgtcgattgaaagtaagagttgcatgtattcagtcgtggccttcatacgccaaaccatggcccagttagtgaagaacgcactcaaatcaacgtcatcttcgcccttagcagcttcttccgcgcaacttaagcctcccgcatcggcgatgttttcggatacggtcaacgtcccgttaactttcgcaccagcaaagtctaagccatcgaattcactgatcatggacttggcaagttccttgaagtgggcagaatcttcctcggtccaccaattatgcaagttaccgaattcatcaaatagggcaccattgttgtcaaaagcgtgcgagatttcatgagcaataactgcaccaataccaccatagttagcgctagaagattgttctaagctgtagaaaggtgcttgtaggatagcagctggaaagacaataatgttcataaatgggtggtagtaagcattgacggtgtccgcactcatttcccaacgggtccgatcagtggctttgccccactttgagaacatgtcttggcgtgccaaacggttaaagtggaggacattgctcaatacgttgccaccttgttcgggcgtgtgcgtcttgaatttcgtgtaaatcgtttctagtttatcagggtaaccgacttgaatgccgagtttatcaagcttggtcacggctttagcacgcgtatctgcgctgagccaagtgttcgcttgcaaccggcgtttgtagacggcaatcatcttttcgaccatctgatgaacgtccgctttggccgcttcaccaaaatacttgtggccgtaatagagtccaacgacttgatcaaaagttccggtagctagatagtaggcactcttagcttggttccgcggttctttttgaccagacaatgcccgtgaataagtcgtggctaatacccgcatttcatcactgaggtaaccactgtaccgttgaacgagcttagccttcatccagttcttcatcagaccgaagttatcaggattgactacttcgttaaagtgatcgaagaaggcgggttctggcaagatgacgaggtcgggattaccatcgatgacggagtaggtgatagcggctaagtctaaataacgactagtgttaacaaaatcgttgaatttgcgaggattatacatcttactgtaatcggccgactcttctgcggatttgatccacggaacgatcaaacgatcgaattgcagcgtgtcatcaacgattttttgtgcttcgtccttttcgtaaccagttttttgcaacagttcggtcatcattttagcgtaaattgctagtaacttagggccggcctggttgccttcgtcgtagtatgtcttgtctggcaagatagtcccaggtgcttgggcaaataaggcgttgaccttggtatttttcatatcagcgtcgacatccaagctgaatggtaatgggaggccgtcgtagatccaatcgggcatccgttgttgtaagtcagcaaagtcgcttaaactatcaatttgcttgagacacggcagaattggttccgcaccattggcattgcgttggtcgaaatctttagctaagcggtaaaacttaatgaattcggttagctgaggatcgtcgggggtaactgttcccgccgccattgcatcaaagtcatgcattaacgttttttcaatggcatcaactaagtccataaagcccccggttgaagaatggtcatccggaatgacggcggttttgagccactcgccgttgacggcatcgtagagatcttgttttactgctgcttgattaatggttgccattaaatccactccctaataaattttctaatactaagttaattataccttagattattctcagtggtatcatctggtaccgactcagtaaaaaatgatactaatcatcttaatagtcccgaatcagtagcggatgggttgtgaatgttaatgtaaagggcaagattacttctgaattatcggcatgcaggagctgttagtgcctgtaaatcaccttatgaggcagcgtgatggttgacgtaaaagcccccggatgactaacagtgatttcgctagtcatccgggggaagggataatttaattagtagtcattattcagttaataatagctggtcggcatcgttaatttcgatgaccttgccaggcttttgcgtaattaggccttgacgctcgaataaggcgagcttacggctaatgctttcaggggtggtgccgaggaatgtcgccaggtcctttttctttaatggtagtttaaacgtgtcggttttgagcgctgccgctgtttcagtgatatagttcgctaaacgggcttcgacggattcagtggccgtgctggttgtttgacgctccagttgactgagacgtttgccaaagacgtttaagacgttgatgctgatactgggatatttttgcatcaagtcttgaaagtctgaacggcgaatactgcaaacatccgtcggtactaaggcttcaccgaatgaggttcgccgttgattttcaaataaggcagcttcgccatcgatatcaccagtttgtaatagatatagtaactgctcgcgaccattggcagctagctgatagactttaacctgcccattggcaacaatcatcagtgaatccagtggatcgtcagcaccaaataaagtgctgccggctggatagtggtggtgacgaacgatcgattcgatggtgtctaattgttcgctaccgagttcgctaaaaattgggactaactgcacacattcatgttctgccataaggcccacctcctgaataaattcaccctaactataacagattttgcttggtagatagggtttgacgttttaaatttcctgctattttaataactatattgtagcgtaaaacttttttgaatttcttgacggccgtcaagttctggtcaatcaaatccggttatgatagaaccatcaaatgaacgacacggaggtaattgattatgaaaattattatgcaattaggaacgttgacttgcccatcatgcatgaccaagatcgaaaaggccgttgctaaccatgacggcgttgagaatgttaaggtgctattcaatgccagcaaggtcaaggctaactttgatcctgaagtgacgaatgccgatgatttggcacaagttgttaccggacttggttacgaagttgaaaacgtcaaggttaagtaggaggaataaacgatgagtgaactaacgatcgacgaacaatacgcagcggaattaaaacagagtgacattgatcaccatgtcccaacagcgggcgcaatgacgaatcacattttatctaacttaatggttgcttacgttaagttgacccaagtgaagtggtacgttaaaggaccacaatcattggcattgcggacagcatatcaacgtttgttagatcagaatgtccgtcagtttgctgaattaggcgaattactcctagatgaaaaccagaagccatcttccacaacggctgaattaaccaagtattccatgttggaagaaaatggggctttcaagtatcaatctgctgatgaactcgtggccgcaacaatcaaggattttgatacggaaaacctattcgttgaccgggctatcaagcttgctgaaaaagaaacccggccggcactggcagcttggttagttgcttatcgtggcagtaacaatcgcaatattcgggaattacaagtttatcttggtaacgatgctcgaactggtttggatgaagaagatgaggatgacgacgattaggccgttgtcgcagaagaattaaacgctctggatagcgattgtgtgggcaaactatccagggcgtttttgctattacaacgggcctgcgctatactaacgacaattaaattatatgggaggaccccgagatggcgattagtgacattgtgatgtggacatttgtctttattattgcgactgggttcgtaacggtggtttcaacggcggtactgttgaagcgagcaaaacgagcgcccaaggatgccgagcagtcccacagtgatgacgacgatgactggaaaaaagatgattggaaccatgatgactggaaaaagggcgattggaaagattgactcgataagttgcctgacagatacggtgcttaactgagtcaactggcactaaaaagacggtataaccaactgagattggcgacaccgtcttttttggcgttatttggtttttagcagtagatccaaggagtgttcaagattctgaatatcagccgtggtcatcgcatctacacaattattaatattacgggcgatgacgagtttcatggccttgtcgatacttgatttcactgctgaaagttgaactaagacatcttcgcaaggacgattttcgtccatcatacgtaaaacgccgtccagttgaccagccgagcgtttcagccgggtcttgatctgcttgctagtgacatattcttcagtagttgccatgattcatgatgcccccttcgtaattaggcaagtacttttttgagttcggtttcaaaatcaggcttaggacgtgctccgaccatgtgactgacgacttggccatctttcttaatcaggaaggttggaattccttgaacttggaattgactggccgtagcttggtcatggtcaatgttcaatgaaacgaagttgacctggtccttgtaagcggggtcttcagaaagggacttaagaattgggtccatcatgcgacatggtgggcaccagtccgcgcgaaaatcaataacggcgataccagtatctgtttctttggcaaaatcttgatcatgtatttctttaatcattttagctgactcctttagtaagtatttgtcactaaataatatacccccataggtatatacgagcaagtattctgtttctggtcgtggagggatttaaaaaggactgatgtattgggtaattagataataacgatttgttgtggaagctagcgtcacctgagaatcttctagttgtgatcgcgagcattaacgttgaagatctcatgttgacgcgagcgtgttatactagcgcttcataattatacaacccagggtatctggtagaattatgttgaattattagaaaccgcttatttaagcaaaataaagcgtttacataaacagttttatctggtatcttcaaattatcatagatgctcggtaccttacgaggaggatttacagatgacaggttcatgggaagcacgctacgccgctgaattttttggcacgctgatcctagtactactaggtaatggtgctgtcgctaacgcattcctgaagaacacgactggtaacgatgatccaggactcgccaatggaggatggctcctggttgcatcgggatatggactgggggtcatgctcccagccatgatgtttggctcgatttctggtaaccatttaaaccccgcgattacgattgggcaagccgtgattggaatctttccctgggcgcacgttgcgccttacttaatctggcaatttctaggagcaattgcaggccaatgcttgattttggcactgtactggccccattatcggcaaacgactgataatgaggcggtcttagggacgtttgcaactagtgatcatgcgaacagtcagttaaacggttttgttacggaaatggtaggaaccgcagtcctgatttttggtgccatgggattatatcgcgggatgttttttcatcaaaatatcgatatcgccaatattggcgttggacttttgattgctgccatggttatttcgttaggaggtccaaccggtccagccctaaatccggcccgtgacttgggaccacggctagtacacgcgttattaccagtaccgaacaagggtagttctcactgggaatatagttgggttcccgtggttgccccaattgttggtgccgttattggaatttggatttataagatcttttttggtttataatcgcaattaattaaccgagcgtatttatgaaattattattggtctatcatttttgattgcaatatgataaaacggtccgccgactagctggggaagactagtcggcggaccgttattggttgctaggcctgtaaccaagttggggagacttgattaagctgtggctgcttgaatggttttagttggttggtgtttgtcgaacttggtttggaaattgattaaccgcatagcgttgaagataacgactaagatactagcttcatggacaagcatcccactggccatgtagatataaccgaagattagcccaatcagtaggaaggccacggtggcaatggcgatgaagatgttttcacgagtgttcaagacagttttcttggcgagaccgtgggcgtgtactaatgcggggaagcttgattgcatcaagacgacatcggatgtgtcgatggcaacgtcagtcccactacccattgcgattccgatatcggcgttagcgattgaaggactgtcgttgatgccatctccaataaaggcgaccgtgttaccggctgcttttagtttcttaacgtattcgactttttcttctggcaagaggttggcgtgaacttcatctaggttcaattcgttggcaacggcttgagcggtgagttcattgtctccagttaacataacgagtttcttgattccttgggcttttaatgcggcgagggaatccttcacgcctggacgaatcgtatcggcaatcccgaagatgagttgaacttgtccgtcaactgccatgataacggttgattgaccaccagcttgtaaatcattgagatctttgagttgggtaggatttagtttgatattatgagctgtcaacattttttgattaccaatgacaacttcttgcttaccgacttgtgcacagattccttggcccttaacggtttcagtgtcatctaggaggggagcaacccccgctgactgctggtcggcataactgacgattgcttggcctaacggatggtcggaaacgccctcaatagcggcagcgagagctagttgattatccgcattgtttgtgtaagtgtgcatggttgtaacggcagtgttaccttccgttaaagtaccggtcttatcgaagaccagggtatcgactttggcaaaagtatcgacgacttcaccacccttgatcaggataccacgcttggcaccattcccgattccggcaacgtttgacactggggcgccgataactaaggcacctgggcaaccgagaaccagtaccgtgattgctaagcggaagtcacgggagaaggcgaagactaagactgctaaaacgaggacggcaggcgtataatattgagcaaagcggtcgatgaacttttcagctttggacttggtatcttgagcttcttcaaccaattcaataattttggcaaaagtcgtgtcgtcgccaacctgagtcgctttgatcttcagatagccattttcaaccattgttccggagtaaaccgaatcatcgagttgcttgctgatttggcgtgcttcacccgtaattgaggcttcgttaaggtaaccgttaccttcaacgacgatcccgtcagcgggaacctggctcccggttttaactaggacaacgtcaccttcgtccacatcatcaacgtcaacttcttcggtgccatcatcagtaactaaagttgcggtagttggtgacatgtcagtcaagcctttgattgcggtccgcgtcttctgcaaggtcttgctttcgagataggagccaaacaagaagaggaaagtaacgattgcggattcgttgaattcaccaataatgaatgccccaatcactgcgatactaactaacagttcaatactgaaaactttgttccgaagtgcgctccaagcacgaaccgcaatcggaatgacggcaataattgaagcaactgctaaaatgacttggtaaccgagcgtaaattgtaagagatatttactgagcatcccaaggacaatcagaatccccgtaactaatgtaatttgattcgtatgtttagtgagaaataattggaatttcataatttgcaactccttatttgatttgatgaccctagtatagtgagttcagcttgatggcaacttgataggcgtcaagttttgcagaataacagtattaattctggattgctggcagtgattatgattaaaacatgccatttagttggcttactgttcgtcagccggtgagcgtcctattccgacctccggggctgggtgacaattgctggaacgcagccgacgtcgatttgagctaacgcacaacccgcgtcatctcaaatacgagtcttattctaagccggaagaaaggcacttccgactaagaataatttggctactgagcattgtcatccagcccctccagtcgggaagccgctcgaatggcagatgaacggccacttaacttggtacaattggtcgttggctattttgataatggaattttaaacgagactttaaggttacattaaccactttgtcgagacgttcgattattactatagtgatttcgaaatagtgagctatcaaaatgttaccttctacctgacagttgctcgacaaaattactgtttataaagaaaaatgatgagtccaataaaagttgggtacatctccgtctgccattcgaatactgtcccgactggaaggcgtttctgacaatgcccagtggtgaaatttcacttagcaagcgtcctttgcttggttagtgaaaggccagtatttgagacgtgttttttcggctcaaatctgtgcccaccacattccggcaattgtcagaaatgcctggaggtcggcgtaggacgaacgaactaagcaggtttacgctaacccgaactgtttccagtgggtctaagctggctgcttttgaatttaaaaaatggcatgttttaatcatgtttcatgacaagttaacggaagaataggtaggatgatcaagtttgagtaaacaagaggtataggagggaaaaaacgtggattatcaaataacgcaggccaatcaacccttgatgccggcatactttcaggggcgttgggcggtcaagcaaattgcggatcgagacgtgatgtatagcactaatttgggtgctgaaatcgattttcaagtcactgatgctagttttgtgcggttgacattcttgccgttggcgtatgagctaccgagttgggtggcgattcagattgatggcttgccttttcaacggcaggcggtgacgaatgaccccctatggttgacactggatggtcggcctcacatggtacgggtagttttgagtggtaatactgatgaggaccgtgtgtgggatggcaatcaaggttttacagtgaaagccctgacgacagatggtgagttacagccagttcggttaggccgacacagtgtgacgtggattggggattcactgacggccggctgctgggtcatgggtaagaaccctgccgaagattatcgcgcggaagccaactatgcggcggttgcgagtgacttgttgaatgcacggaatgtccgcattgcttatagtgccgttggtctcagtaaaccaggaactggtggcgtaccggtactgccggaggttttaacagccgtggatagtaaaacgacgtggcaaccagtacccacggatttagttgtgattaatgttggtactaatgatcggcatacggatgatacgacgttcacggtagttttgcgccgctttcttaatcaggtgcagacgctttacccgaatagccggcttgctgtaatgatcccgtttaatcagaattttgcggcgattattcgcgcggtcgtggccgaatttatgcaattgcaactcattgaaacggctacttggcaactcagtaccacggacggggtgcatttagatttagctggctcccggatggcgggcgaattaacagcacaagcgttgcggacacagtatccagatgtttttaaatcgtgatcaacccatcttataaaaatcccgttttactgtagcgatgttctgctgcagtgaaacgggattttttggtggcactactagattttaaaaataaacgttaacgctggcggtgtagtgattgcgactgtaaataccgggccgcagcgagcaccttttcgggaatatccacatgggcgatgaagccctgaccacggggaccataaccgttgggggtatccactaggcgttgaaattcaccgagtaagagttcagtaaagtaagcgggttgccagccagctaatattgtgtttggcgtaaattgcattggttgtagccggtttaattgcaaggtcgccggcgcatagcgaataaagttggcattgggccaattggctgagaacgttagggtagtccgccgcgcgagtaacgggtcttgtacgagtaggacgtggcgccaatcggtgggggctaacgcgcgggcatgcgtggcattgctaccagtattggtagaagtcttgtcgaggcggatactaccttgatagccagtctttcgaacaagcgtcgccatcaactcagcctcactagcttgagattttggcaggtttaagttttgccgcaaatacttagtggcgtggccgatgccgcccgcaataatgagtagtggtaattgatagtcttgggctaactggcccgctgcagtggctgttgctgggaggctgttgccacaaaggaccaggccatcgaggtgctcaggcaaggcggtggtgtgtgtcaaccaagccagacattgattgaaagcggtcagttcgtccaattacttggcctccttagtcccaaagtgagccgctgcggctccaaagttgaaccgttggaagtgaacattttgaaagcctgcttgctgaaacatcgttgctaactgttggtagcttgcaaagtgacgagtggtttcctgtaaataggaatattcctgatattgatgggcgaataagcgcccgaatagtgggactacttttgtgaaataccactgccagactggtttaatcaatggctgatcgggttgagacgtctctaagcagaccaagcgagcccccggttttagtacgcgataaatttcagttaaagcttgggctttatcaggcaagttgcggagtccgaagccaatcgtgacgaggtcaaaggtgttgtccttaaacggaagatgcatcgcattgccgcggcgcaaccagacccgatcggcaacctgttgctgggtcactttttgttgtgccagttttaacattggggctgaaaagtctaatccgatgacttcaccgggtgcctgtaattctttagccagcgcgatcgtccaatcacccgtaccacaacagaggtcgagaacatgggcgttaggcgctaaatggatttgtgccatcgtttgcttgcgccaatgacgatgcgttccgagactgatgatgttattcatccgatcatagttcggcgcgatggtgtcgaacaaaccttggacattatgtaaatagcgatttgccataaatgatacctcctgatagttgctttacttactactatagcagatgttggttgccagttaccgtgaaaaggaatgataatcaatattgttcgtgaataaaccgttaaactaaagttaaaacaacataaaggcagtctcgatcggtatgtattaagtaccaatcgagactgccttttttgacagcgtgttcctaatcgaagcccttaacgtcaaaacgagtacgctagtaatagcttaaaaatcatcatctgcaatttgagcgaacaggtcacgtgatgggatgaagaacgcttgtccggatagtaaagttgagaaagttagtaaaaagtcactttggtcgaccatgttttgcagcatgcctttggtaacagtccagtgacgggcataaccaatgaagtacgtccctgtgttaccagctgctggattggagtacgggacattcatccgaacgattttttgttcgacaccatcaatttccaattttgaagcaacgttgtgagcattcttaaacttgtcttcgtcttctaactcgaagtcgctgaatttttcgcggcccacggctttttcctgatcctcggtgtgcatatgttcccacacgggcatatcatgttgccatttctgtgcaaaggcgtaagaaccgttgatgaactggggatcttcgtcaccaactaaggcataatcagcggcatcttctacggccggcgcttccgtaccgtcgataaagccaatgatggcccggccctcgaagtaacgaaagcctttcgtctcatcgaggacggttgtgattggtgctaagacccgttggaactgtgtttggcattcgtagacgaccgcttcgttgcttgcacgaatgtggaaaaagaggtcgccgggtgttgctggcatggtgtatttgggtccacttaaggtagtgtaggtttctaattctttaggtttgggtgcgccaggaaacaggtaatcccaagcggtactgctgatgccgatgctaacttttaattgggtaccagtttcaggtttggcgtcccggatgcgcaacgagcgaatgatggcttgtgaccgatctgcaaattcttgaaagacttcacggtcgtgttgctgatcctgccgatttaattgaagaacggtaaattgaacgtgttcaccgacatccttccagacatcttgggcgcgatttggattgattggcatggtatatttcctccataaattgtttgatattgttagcgtacatggtggtacgggtagcgtcaaataaaggcaaacggcgggtgtgaataatgacgacattcgccagcatcaggggtaggcggccaaactaacgtggtattagaacatgagtaataatgattagcaaataagcgcaaagctagtttcaaatttgaaactgtattagtgggtcctgtgagctatagctcacaggacccactaatactttaacaaaaatgaaactttatctgtcctaattgcagataattgtaattaaatatctgtgtaattactaagtaatttgtaaatcatcgtttttagcaaggaatagtttgagacatttagacggctattataagttttgaacggattagtcagttggaattatcggtgtttgtaatagatggctcacagccatttgtttaatcgtgagggcttgtactcataacgaaaacaggtattttcaaaggacgcaatccgaagtcgttttaaacgaccttggattcaatcaaaaaaagacgttttaaatgcatgagatacagttagaaaaagacggggttgggccgtgtattaggtaatagcatgtgaatattgtaatgccccgaattttcgggtgattgaaacttattgtgacttttccaccagtttgaatcagtatgcccctcatggtaagagaagctacacttttgattaatttgttaaggccaagtttgcactaagcgttcggactatatggtttataaactatatagcgccggcagtgtatgtcaaaatggccttgtagatacctgataaaaagacgaaagtggatgaaaaaaggtaggctatcgttgattgtagcagagataattgaacctgaggagttatctgaacaataaagatgtgttcagttttggacagattttacaaagccatatatttaaagatgtgcgcaactttgcgcagatgttttctagcgatataaaatggaattaatcattttcaaagacacctgaaactcgtgcccccattgatgtacagcgtgatttaatgaatttagaaagtgtgttttagtcaatttgaccagagaaatttgcaattaccctagcaacactggataatatagaagttgcctacctataccgtgtaacggatgggaggtgtctctattgttcaattcgctaatcgccccgcttattgtagctgttttaaccgctttgttttcaaagtggttagatcgtaaagacaagaagtaggctggctaggcaacatctaatacacccgtttagtacataagcgtaaaaaataccctcaactactgcaatagttgggggtatcggtgtctccaatgttcaattctaatcgcaagtacattataacagctatataaggcaaaatctaatttatctagctatcataaggaaaaaatgtttttagtcatatataacaacactttttaagcatgatccatataaaataaaaaaccatccgtttaagatagcttttacatcagcccaccagcattaaaagtgttctggatcctactatgataagtgattaaaattcaatgctgagagattaattaatgatttgtatacatgttcatattttattaacgacaaaccatccaataatcgttaatatgatggtttgaataatttttaatctgctgtctatgattcggtttttatcgtctaacatccacttccaaatatgttttacgcatagaacgataactgataccagtacatatgattgtaggattaaaacgatgtaggttaagccaaaattattaccgctacttaatagttttggcgtgaccaatatttctataattgaaagtgtcatgatccaaaatagtatgtattgaaatagtctcttaaggtcaattttaaatttttcttcaggagcaaaactgattgctaaggataataatgatattcctagaactaataatactaatatagaatgccaaacagagagcataggatcggttagaaatatgacggggtgctcctttccgtatcccctcccatcggtcctaaaatatatcaacgcaaagaagagtatgttactcaggaagaagctaaatgaaaatttaaccattaagttgaaatgaacattgttatgaaatctttgtatttcttttttaaataatgacgactgtgtaagtttatttatcatacaggtacctctcctaagttgtttatacaaagttgctgaattattgattataattgttaggctaagtagtcaaggcaaaaaataaccgccacccaatcaccgggtaacggtaaacgcctgtcagtcaacggattatattctgatgttatctccgatgctttccatgttatccaattatggataaatagagtcaatcaggatttatagaaaatactggtttgacagcatttattagttccggaaaacactaatatggaccctaccggatttgaaccgacgacctcctgcatgcgaagcaggcactctcccaactgagctaagggcccaatacacttttagtataccgcaaaatgctagtcgtgcaagtctagtttggtcatcaatggcgactagcacgatgattttgattgccacgaattttatgcactcgtcgtttgtactgtgctttttggttactgacaaacttgaagtgctgcatttttccgccgaagacttgaccgttcagccttaattttagccaatcttgcatgacggccatcattgaattaatttgggtgatccgtaatttgtcatgttgttgttgtgctagtggtaataaattagtagctaactgattaactaatttttgatggtaggctattaattcgggtgttaatggggcatcggtataagtattaaataatttttgaattgtttgaagtgcatctttgatgtcggttggttgataataatgatcgtctgtattcgtcaagttaatttcccctttgtcattttagtatagcaaattttatttaaaaagcatggtttagcgtggtcaaagtcagcggtggcggttacaatagggataaatttaggaggtgcgtatcatgaccacagtaaccgcattggaaactcaagcaggccaagtcttggatcagtcctacgcccagtttaaacaagcccagttgacgctgggcaaagagcaggtatttgctaacgctgctcagatttttacggttgatgaaattgctgctgcgacacgccaatatctatttgacgaagagatcgcacagcaagtgatcaagttgcaagaccaggtattaccgaccatgtatcaacagggacaacgtggcgaattcttgaagttgaactttacggggaatgatattcgatggctattaggattaccgcgaacacatcatcgccaacgaaagtctaaatagtccaaatgaaccgaacgtttggatgtaatcaaattgaaatttaaccgaatttccaggaattgtcactggaaattcggttttttaaaataaaaataactttttttcgtcaaagttgctgaatagcctcaaattttagtaataaaacgatgccggtatgatagggtttcagcgcggaaatgttacgatggctaattattgttacggttttgtaactttcgtaacatattgttattttgctggtattggtatgtaacacaaattgagtagtatagacgttggcttgaagtacatacgtgacattctttttggagtgatcattattaaagtgaaagtaaatattaaacaagtaatgttaggaactgctgctttagctggtatgttagttactagtcaagcagttgccaatgccgattcaatgacaatcaaagcaggggacactgtttgggcatacgcacaaaagtacaatgtttctgttgacaagattgctgaagctaatggcttaagcaaccctaacttaattattgctggtaagactatcaatattcctggcgttaaaactggtgaaaaggttacgactaagacgaccactgctagtgcaagcagtgctaagtcaactagtgccgcaacttcaactagttcacaagctactagcgctgctgctaccagctcatcaactactagtgcaagtagtacgagccaagcagtatcaagtagctcagtagctgctcaatcaagtagcacttcaactgctagtgcaagcagtgtcacttcaagtgcttcaacgagttcagtagcttcacaagctagctcaagtgctgtaactagttcagcaacttcacaaagctcagctagccaaagttcagcttcacaagcatcacaaagctcaacttcagtagcatcgtctactagcacgactgcaactagtacgcaatcagctgctacttcaacgagctcacaagctagctcaactgcaagtaacacgactagttcatcaacaacgactgctactgcaacggcctacagtgcttcagcatcaactagtacatcaacgactagttcaactgcatcatacagttcagtaattgctgctgctaagaccttcattggcacaccttacgaacaaatggattgttctgcattcacgcaagctgcctttgctaaggttggtcgttcaatcggtcggaccacatatgctcaagctacgattggtactcacgtatcattcagccaagcccaagctggcgacttgattttctggggttctgattcagcaccttaccacgttgggatttacttaggcggtggccaatacatcgcttcaccaacttatggtgaaactgtttcaattaagagcacagcttactacacaccaagctttgctatccacatgtaattaatatcccttaaatggataaatagcatcatcccggttcgtcagaatctggatggtgctattttttgtatccacgagtgataataattgttttctgaagtttaactattttatcaaaataacgtgatgattcagtgtgtgaatccgtatttcttaggtgccgcgtcatgatgatagacaatgtgggcgtggtttaagtcatggacagccttggtcaggtcatccatgaaatcgtgggccatattcatgccaaagtcagcccgaacgacgattcgttggatgacttgttgttccagattagcaggtaaaggatacgttggtacttgccaaccgttcattaataggcgatccgataaatcataaagggtccattcacgatcttcgcgcggggctagttggtaacaaatcagggggagttggtgtccgttattgaccatcttaaactcaccaactttatccagagcggctgccaggtagcgggcaacatcgtgagtctttgtttgaatctcgcggtaaccgtccataccaaagcgaatgaaattatagtattgtccaatgagctgggctgcactatgtgagaaattgatcgccattgtcggcaactccccacctaaataactaactttgaagactaattctggcggtaaaaactgacgatcacgccaaacgacccagccgaccccgggataaactaaaccgtacttgtgcccggaggcgttgatcgaaacgacgttagccaaccggaagtcccagatgagttgcggctcaataaatggggtatagaagccacctgacgctgcgtcaacgtgaatgtagactggtaatttgggatgctgatgattgtagtgagtaacgaccttatcgagtgcggctaggtcgtcatattgaccggtataagtgatgcccatgataccgacgataccaattgtgtattcgtccacgtagtctaagacgtggttaacgtcaagggccatgtgttgctcatccattgggaccacgtgcatgtcaacgtcccagtagacacaaaacttttcccagcaaacttgatagccagccgaaataacgaggttaggtcgatgggcattcagatctaaacctgccgcttgagcgcgtttacgccaggcgaatttcattgctaaaccgcctaacatacaagcttcagaggagccaatcgtagaggtacccgtaaagtgttcgtcatcaggtgcgtgccacagattggcaataatgttcacacaccgattttcaatctcggccgtgcgggggtactcagatttgtcgatggcattcttagccagcgtatccttcatcaattcaacggcttcgggttccatataggtctgacaaaaagttgccaggttcagtcgtgaattgccttcatctaataattcatcacgaactaagcgatcggcttctcgaggggataatgaatgctttggtaaccgatacttaggaagatcatgttgttcagaaggcgcaccaaagactggttccaagtattcttcagcttcatgattgtgtttaccgtataacattgccatgttggtcacccttatctttataagttgtgccgagtatagcacgaggtgataacagggtaaattaaaatgcaatctggatggtaggtaacaaaaaaactggtcgaatggacgaccagtttttagtgaggatctttgccccaattaggctttatcgctgaactagcagttaagctttggctttgctattcatgaatttcttcaacagttgcaattcttcctgagttggcgttgcttcaccagatttaatgttgtgaatccgttcaactgataattgactgccaaacgcaaggtcgttatctgtaagatggtgctcgcgttcaaaactgatgagcttttctgataattgacttaatggtagttccatgctcctcaccccgatttttagaattcgtaaaagttcagtgccatatacctgctacttttattataaccttaattggtctgaagcggggaacgaatgccatcctattttgtaattggttgttttaattgatcttgtaggtggaccagaatatcaataatctcatggggaagctggtcatgattgttgtgttgatattgatcaatgaagttagcccgaattcctaaacgagtggcgaccaagttacggtagtctgcattggcataatcaactgggaaatcagctaactttaggttttgcatgtgctccaagcctgcgaatgactcccactcggtcgtatcattgacaatggcttccagcgcacccaaggtaacttccttaggaatcttcttatcgccaaagaagccagtattcaatagataacaatctaaatggcgttcttcgaagagtgccttgaaatcatggtaatcttctgatagtggatagaccctaaatgggtttgcaaatggttcgatcactagggcgttacggtcgacattaccaataatattttcggccgagctccgtttggtcgctaaagtggcgccgaatgtcgctgctaatacgggatcatctactttaatcacgggtggtaagctatcatctttcataatccagaagattgcattgatgggagcggcttccttatcaacccggttagtcgaagcgtaccgtgacttgatcgtccggccgttaccgttgcgcagatcttcagtgacaaggaccttgcgaccctgatcgtctaaggtgacgccgacgttttggatcgtcataaaatacttggtctcatcggacgtcatcggatagtcgttggttttgtcaaagtaagaaggctcgagggccacggaactaccatccttgcgattgatgacaaaggcgtcgtcgtggagaacggtgatatcgtatttatagccgtgtttagcgtgggttagtgttgacttaccggaacctgataacccgaacatggcgaagacttggtcttgcttgtccttgaagtggaaggccttcaagccaccgtgacaagcaacgaagccgtgacgatgggcgatcgaccaagctaaggtcaaagtcgatttcttcaactcaccaaagtatggcattcctagaatggcagccgtattatgttgcggatcaaaaatagccaggccgtctggataatctggatcatggtaagtagggtcagcgtaaatgtaaatatcgccttctggataagcaacggaccgatcgaacatttcttgataagcagcggtgatgggctggaagttaagcatgtaagaaagtagattattggcaaaaccgtccggaatcgcgaggtgggcccgcacgatgaagtcttcgtctaaaccgaccagaacgtccgtcgtgatgaagtccttgtgagcactagcaaatagtgcttggcgtaggcgaccggccatatcggcttcgctaacgcccgggttgcctagaatccggcgcgcttgtgcggttcggccaacaaccttacccgtattggcaatcaacatttttgcatcagctggtaagcctaaatccgttgcgcgatagattgggaggtccgtaataacggttccggggtccttagtagcgcggtggtaagcggcagcgatatcatcaacgtggtgcatattattaccgtaaaaggccgtttcgacggtagaacggatctgtgaaaagatcggattatggcgaccgatatcggctaattgataagaatttttagtgctcatattgtagcctccctgcaagttgataagttaattttagcacaaactttcacataagaaagcgttttcttttttggctgatgaatagctgctagtgcgtttagacgattaagacgttaagccgcagtggttgttaactaacttgtagttggaagtactcgcggattttattgataagtaatgatcattttgatagttgaggctgttattaattaactttccaattaaattatcacttgcgttcaaagctatattagtatagtttattaaaagagaatgattgaaaatcagtgatagggaggcacctttcttgccacgaagaaggaacacgcaacggcgaatggagattgttaatacagcgtttcgcttgtttgccgagcaggggtatgcgaacgttcagatgaaggacattgccattgcctgtgatatcagtaagtcgttgctacaacactatttcccgaagaaaatcgttttattaagtacgatgttaaatgagttgacgcttagtgcttttatctatagtaatgaacagctgaccatgctgtcttcgtatcagcgaacaatgattcaaatgagctttgttttgcggatgttagatgaaaatccgaccatggaacactttattcaggacatcttcgagagtccggaactgacgactgagatggtgctagtgacactagactggctagaagctatcggcgtagaaggtgaagctgctatgattagatacgcgttgaacttcgcgttatctggtggtatggctgtttttttcaagcgtaaaattctaagagctagtgttggcatgattgcagaaaatatcgaccaagcgttttacttgttattaggtgagaatactgagaaaattgatcaaatttatttgagcacagccaagtataatactgactattattatcagcaattcatcacgtatctgcataaacacgcgacccttgacttgagtactgaaataaaaatttaatattaaagtaatctaaattacttgtatttcgtaaaatatactagtacactttaaagcggggaaatgataaacgacgcttactaatttatgaaaaaagtatggggcgaattatgattgggaatttaatgataattcgactagtgaaagggagacttgaataatgaatgaagatatggaattttttaatcgctttagccatatgtatttacatggctttaaaaacttatcagatatgtttgctgaacctgcaacggaacatgggattactttggatgaattttacattttatatgatattgctgaagcaaaaggtaagatccgtctgatggatattgccgaaagtcacggtgtgacgcgttcagcaatctcacgcttaattggtcgcttattacggaaagattacttatatcaagaagctgaagaccatgaccgtcgtaacaaagttttaaagttaacaccagaaggcgctcggattgaacatgaagtctttactgaattgattcaacgcaaccgggaatggcgtcaaagcttcagtttagctaaacaatatcagactttgaacttggttgaagagtttatggacaagtttgttaatgaagatgctagcaagcaaactaaaaagacaacgtatgctgatactgatttgaagcgggctgaagcttaattgagtgtcagttacaattaaagataattacaaaaacaaccctgttggcgtcttttggtgctaacagggttgtttttataatcattaatgaccactgatcgtgattcggaaatgatcaagacgataggtgctatgaagtctcgatggtaataggtgtcaagctggttgtttgcgctatcagatataatccgtgcttgtacttaaaataagacttattagtaattatttttggaaaaagtgagcgcttactgtttgtatagtagtcacattgattgggtgatttgtataaataagacgagcggacaaatactcgtcttactcatatgaactttggttgccttttaacctaatagcgcgttcaaggtttggttaggagcttgcttgatattgcagaattaatatcaagtttaagagtgattaaacttatatgcgaattttaaaacacaaaaaaatattttattgtacaaagtaaatatcctatttattcttctttataaaaaatttgattcaactcgcgatatttactcggagtaatatcgaattctttttgaaactggcgtgcaaattcggcgctattgtagaagttgattctttctgcaatttcacctataggaagatgggtattaattaataattgctttgctcgctgtaatttagcgtggcgaatgtagaagttgatggtaaaccctagttctttacgaaatttacgcttagtgtattcagaatctaacgtcagttcttctaagatggtatttgctcttaatggctcatcacaatgattatcaatataatagacaactagcgcgacttgcttagagaggcgggtaccatcaattggaatatcaagtgtatcaagattgctaaaataattgttaacgattgactctaaaagtggcataaaatcatcattcgttagtgttgttgttgtgaggtaatgcaaaatgtcctttcttaagttaacgaatgtgatcatgttcaaataatgataaaagctgacacttgctagatcacaggttagtgaaattaaggcttcttttagaatgagtgggcggacgttgtataagttatccttgattttgtgattaaatctattgatatgttccaaggcgtagtcaagacaacgcttttcgaaaaaataacttaaatcatgttccaatatagcaaaatcaaaattgaaatcgcgttctgtttgagaaagtttgagctctggaaaattcaatggacagttcctcccccgtaagttacaaaaatagtgaattttatacaaatagtaaacgtacataatagtgtacttgattaactttaattggtatgctttaattggttcaaggataatgactgatttaagttatccagtatagacatataaatattcttcgtcaattagtttgctaaaagtttattaataaaggtgaatttataatattgatttaaatattaatatgtttgtacaaaaaggtattacgcgctattgatgaagaagattaatatgctaattaaattttagggggaattgacttatgacaaagtcacgtacgctcaaagcagctatgctggtttcagtagccagtattgcttgtttatcattcaataatttaggagcttccgcggacaccttgccttcaactggaaagtctcaagcagatgtttcgtttacgtctaacggtggttcgactaatcctgttgatccagacaatccggataatcctggcggcggtggtactgggaacaacgggccactttcgttagatgcggtaccaacgtatcttaattttgggacgcatacgcaacctaatgttgatacggcctacactttactttcaaaagatgctagtcaggagagccttgcgacagctaatgatgataagacccaaaatgtgacgactagtggtaagaaaaatggtaatgatatcatttacacgcaagtttctgactcacgggggactggtgctggctggcaattaaaggcacagctttctgatattacggcttctgacggccaagtgttaacgaacgcgtcagttgttttaagtggtgggacaccacaatatctgacaggggaagctaatcaacaatcttgggtcactgcggcggatgcgaaccaggcaaccgttgcaacaccaattgtgctcaatgccggcgcttcatcgacaaccgatgttgcaacagccacggcagggtctaaagttggtgacggtcaaggtatgggggtcaaccaacaatactggaatattaataatgtgcaattacatgttaaaggtggtcacgcagccgctaagaattattcagggaatattgtttggacattgaactcgacaccaacggcttaatgaacgaaaacgagtggctatgttgaatagttaactcgtttttttgaagggaggcccttttatgaacggctggaataagaagctattattagggatgttaaccctaataatgactttgttggctggtatgactgtgattggccatgctgctgacacggccaataatgcggtaacttttgatgttcagccaatgcttaatgaaaagcaacaattatcaaaggacgcttattattgggattttaaaattcaaccgaagagaacatattcgttagcgatgcgtgttaataatcgctcaaatcatgaaattaaagtcaaaaatcaattcctacaatcgtatactaatgcgaaaggtgttattgattatggtgctgctaatctgaatgatgatactagtttaaaagtaaaactagctgatattattaccgtaccggatgaggaaacgacgatcccagctaataaatcacggatcgtgcgggcacagttaaaaacgccaacgaaattgaacaaagggattattttaggaagttggcaagttaaaattgcagatcaacatcttaaaactaagggggcgacgttaactagcgaatatgcctacaatgtggggatcaaactaacgtcaaatcgtgatccattgccaaaattacgcttggctgatgttcaattaaaaaagcggagtggcatcaagacagttatcggtaatattcaaaattaccacgcttcaattctaggcaaagggactgtcactgcctacgttagcaaagctgggcagaccaaaaagctcgcggtggctgatctaaaaagtagttcgatggctcctaattctaactttgacttaccattaaagtggcgtactaatcgggggatcattttacctgggacttacactctatacgtcaagtatcgaactacggatgaaaagttcgctaagccgcatgtctggtcgctaaagcaagattttgtagttggcgctacggatgctgttaacgtcacgtctccaactacttggggttggttgattggtatcgtgttgttagtattattgctcattgctttaatcatattctgggtaattaaacggcgtcaaaataagcgctaaggggtgatactatcaaaaagctaagagcaattgttgtcatattgatggtattgttacaagtcatagccgctggtgcaacggtaagcttaggcgccgatatgaccgctcaagcagctacgttaccacagttaacttttgcaaaatcaacggctagcgataatattttaacgaatcaacattttgatgttgaactacagattggtgatacggcctctaaaataaatacgattgatttaccgaacgaggttaatttagatgggccagaggagtttaagcaaataaaacgagttttcgatgatagtcagtacacaacgggggataatggcgcctttacaattacggctaagcatctgacagtttcgtacaatcctgataagcgcaggataacggttcagtggtcagatgaatatccgcaaacgaaggtaccaattagattaacagctgttaaagcagaaaaactggcgttagttgctgtagccgatgatcaaaaagggccggcgttgaatgtcgagattaagcaaccacaaacgcaggctgatcaggccagtacgagttcagctagttcttcagcggcaaccgatacaaatagttcgacggcatcgtcaagtcgacaagcgacatcatcagcagcaagtttggacagttcacgttcagcggcaacgacgctttcaagtcaggcggtaaaccaaacgagtgctagcagtagcgagccttcacaagaaactgctgctaatcaatcgtcatcggtcacggaatctgcgggtgagacaactgatagttcggccagcatctcatcgtcatccactgctagtcaagtgttctcatcagcaccaactaagcaagcaacggcgagtgccaaatctagtccattaataccagtcactcgtttagctcagctgagttcgaatgtggttgatgttagtcagtggtctcaattagtcgatgcttggaaggatgcgagtgttgatgaaattaatattacggctgatattagtaatccgactgccgcttcaggcgctttggattcacgattatccggtaatattattgtgaatggaaatggtcatagcgtgaatattggtcgggccggttttcatactaggtacaatggtgctaccagtagtacaaaatatacagcaacctttatgaattttacatcattaactggatcttttggaaatgatgcggggttaatcgggtcaactactggtggtgatggggttaatgccgctttaaattggacgtttaatgtcagtaacatcacggttcctagtggtaccagaaattccgatacgagtcgtcgttttgttagtgccgaaggaaaccaggttaatgttacggggaactgtcaggtaaccacctatcgagaaaatgtcttatgtggaggcttcaatgtcgcggctggtcaaacatttacaggttcaaaattagcgactggttctgataattctttcatttggtttatttttgatcaacaaggaacaggtgatcgcaaagtcaatgttgaagaaggcgccaccttgaactgtattcgccgaccagtcgatcccacctcaacggcctatacatcgtatccggttatttttgatgcatatgaaagcattaatgtaggcaaaaatgccacgttcaatgctagtgtgccagggaatgcttactctaatcactacttctatggaagtacaaaatatcatcgtgatttttacgcggatactggcagtaccgttaatctaacatcattagctagaggccagtcaccaataggattcattgacaatgcaacttcgacgattcaaagtagtagtggtgccaatatttatgtaattgctgctacgggagcaccgcttatttcgggaaattacgcgcgtttggctactgttcgatttattaatccgaacaacttggatttacgtaatagctcaactggaacgactgcagcggctagttcgattaaccaagataatgtgggcacttttgaaatccaagatagtaatattagcttgtggaaattagcatcatcggttacgggcggtgcggattattcgtatagtaacgtatctcagttattacaacagggttcagcagtgacggccacggatagtaatttgcaaagtaattatttatcttctaaaatgcgtcggattagtgccactaaccagaagccacaattagcatttaataatccgtatgatgggacaaccaagctaacagatgcggatcagaagctgcggacgcgagtcattgtggcgatggttcctgatactaatggtgttcaagatgacggaacggttaattatattccacagtatgctagtgcagggcaattaaccgtgagttatagcgttaatggtaagacaatcactgcccaaactgatagtaatggctacgcaacagctaatgtcgggacctttttaaaagctggaacgacggtcacatcatcgactagcaataccagtggaacgacggtcacggctaccgggacggtggttgatgtgacgccgcctaatccggccacaatggtatcaccggaccccattagagtttcaacaggaacggtgagtggtcaaaatggagaaccaggtgcgcaggtcacattagcattgaatgggcagattcaaactaatgtcaaaacggttgtcaatgccaatgggacttggtcgctgaacttaaccggattatcgttaaaaattggtgacaagattattatttatatggctgatagtctaggaaatcgtaatcctgatcctaatagttatccaaatgggcagcagtatcatgatgcgactttccaaccagcaccgatatttacagtagctaaggatttaatcgtcaatccaattgatcctgatgatcctagcaagcctgggactggcgggacgaacaatttgggcccattatcgttggacgctgtacctacacatttgaactttggacagcacagcattccaacaatggatacagcgtacccattgttgtcaccatcagccgctgaagaccaattggctactgctactgatggacagaagtatgcaacagttggtggtcagaaaaatgggcaggatagtgtgtatacacaagtgactgatacacgggacaccccaagtggttggcaattgacggcccaattatcagcgttgacagctactgatgggacgaccatgacgggtagttacgtgacgttaacatcaggaacagcgcaatatttgaatgctagtactagtaaatgggttacggcaactgaccaaaatcaggcaaccttaccagccgtgattaagttaaccccaggtgctacccaacaaacgttaatagctgggacgactagtcaacaaggcgtcgggactaatcaacaaatttggaatgttaataacgttgcgttgcacgtcaagggtggtcgtgtgatggctaaaaattattctggaactatcacttggcaattgaatagtttgccaagccagtgatcgttatttaatggtatgcttcaaggcttaaaaagaatcggacgacaaaactgattgcagttttgtcgtccgattttgagtatccgagattaataattagccaaagattgatttgaaaatagagctgaagaagttaacaatcgcgctccacattttttggagcaagttttgattttctttagtattgagtttgctgaagacacccttggcatttgattgaatgttcttcatcaacgagttggcttgagtcttaaagcttgaagaatctaatgcacctgaatcacggatcttgactaacaaattaataatttcagtcttttgattattagtaatgacatttgttaaattgttattggtaatttgttgattgacaatggtcgtgatttcgtttttagtgatgttacttcctttttgggccatttcctttttggcaccagccacagcgttgttcaactgggaatcagtataaccatccttgctcttatttgcttgggtgatgccactgagagtacttaactcatcttgggcggcggttacttgcttcgtgtttaagctgttaccagattttgcgtacgctgcgtaaacaccggctagtgcgcccgaaccgtcgattggagtagctgatgtgacgtaaatattagcatcggtaatcccagccgttagtgcggcgtttttatactggttagccgtaatagtggtgatgttattactaccattataatttaaaattttgacattaattccagaaccagaacttgttttttggatcatcgcactggaccacacacctgagctacttgtgaaactttcaccggatgggttgaggtatttaactagagtatcgccgttaacagttagcgtctgataatcggcaccgttcaagctagccgttaacgtgttgatcgtcccagtcttttgactgctagtcaggctactgcctaatgtgacaattggttcatcgctgctactgtcagcgtgcgcaaggacttgccagctgccaatcccaacgatcagggtggcaacgagggcaacccatttaaatttgaaactcattcgtttcgtcattttcttttcctccgcatcttaactaatgcacctaaatcctaacatgaaccgttcgctcccgggttgtacagtggcaactagcgattgcaaggttaggttatgtcattattatagcagaccgtggtcgtaagttaacattcggcgcgtaaccttgggagagtcctaagtattttaacaatttgtttattatttgccgaagtaccagactttcgctatactcgaaataaatatcgggggaggttataacaatgacacaaaatcgggtgattaacgcgttgagctatttaagcattttattcttaccagttttatttccattaattgtttggttgctgacgagtactaatccagaagcacatcgggttgcaggacgggctttttggttacatttgttgccgacaattttaggaattacactgctcgttattttaggcgttagcggtatttatatggacagtatcgttaatagtggctggttggccgtggttcttttagcggtatttggattagtcgcagtggctagctacttatggtcgattattcgcggaattcagtatttaattgctgattaatgtagtagcgttaggttcaggagggtttagcatggttgttaaggacgcatcagtggttgaaacagcaatgatgattcaattttggcagcgtggttattatcaaacgacagttgacgacttgctcaccgttagccagttgtcacgaacgcagttttatcgccagtatcacagtaagcgggttgcgttacgccgttcacttgaacgctatcaaataacgttagatgaacaacttgatcaattgattcaacgtgagcgggcgcggcaaacaccattgcccgctttaattgcggcttgtttgcgactgccgtttcagagtgaacggtggccagcaggatgtttgatggtgaacctgatggccgaaattgggtcgcaggatgcgtccttgatggcccaactgcaaacgatctatgctgatttacagacccgactcgtcggtttactttcacctcaggctaaaaccttaccgaccacggtcgctgaggctgcagcaagtttaatgcaggttcgcagtggcattcagttattggcaaaaccggatcctagtggggcacagctaaaacaacaggcccaaacgagtgttaatctgattatgggggcagtttaagatggttgagattaaagtcattcacggtgatattaccaaaatgaccgttgatgcaattgttaatgcggccaatacgagtttgcttggtggtggcggcgtcgatggtgccattcatcgggcagctgggccagcattgctggctgcctgtcgcccattacacggttgtgcaactggtgaagccaaaattacgccgggctttcgactaccggcgaagtatgtgattcacacgccgggtcccgtttggcaaggtggccagcataatgaattacaattgttagcgaacagttatcgcaacagtctgaatttggccgctgagaatcattgtcaaacggttgcttttccgtctatcagtaccggcgtctatcactttccgctatcaattgcggcaccgttagcgttaaaaacgttacaagcaactgcgcagacaacggcccacacggttcagacaatcacgattgtttgttttgatgaccaaacgcaaaatgtatttagtacggcgttggcagcgctgacaaattaatctttaccaaaaaaatacacatggacgctactatcttgagtagctgcttgctataatgttgatataccggccatcggggatggtcgtaaatctttatgtattgggattatcaagcgataatcattgccaacaagaaaggaatccattgtgttagatatttttaaagcggtaatcttggggattgttgaagggattactgaattcttaccaattagttcaacggggcatttagtcctagttgacgaatttatcaagatgcaacagtccacgcagtttacggatatgttcaacgttgtgattcaattaggggcgatcatggcggtcgttgtcctgtatttccataaactaaatccgttgtcaccacgcaaggataccacggaaaagcgaaatacttgggttctctggagtaaggtgttattagcggtcattccatcagtgatcgtggggctaccgttaaatgattggatggacgaacatttaatgaattgggcggtcgtttctgccacgttgattatttatggggtcctattcattgtgattgaaaatcataataaacgcttaacaccccgcttcgctaatctacaaacgttaccttatacgacggcattgttcattgggtgcttccagttgctctcgttgattccagggacttcacgttccggtgcaaccattttaggggctatcttgattggaacttcacgctacgtcgcaactgagttttcattcttcatggcaattccaacaatgtttggggcgtcattattgaagcttgtgaaattctttgctcacggtggttctttagctggtttgcaaggagcagtcttagccgttggggtgatcgtgtccttcgtagtcgcttacttgtcgattcgtttcttgttggattacatcaagaaaaacgacttcaaggcgttcggttggtaccgaattgtcctgggggtacttgtgattggctactttacgttgattcattaaatactagaagcgtaacttttggctaagcttgttgccgcaaatatcatgaataaataaagtcagcgactataaattagttgctgactttttagattatatcattactagtaatggatggaccgtcataacgattggataagtgataaaccaatcgttatgacggcttttttgaagtaatcgtgttaccgatgaactaatttatagttggttacgccgtacctttgattgaatgtgattctgacaatttgtccgcgtttgaatggggctggatcagcagcaactgtattaaaatgaagatactttttttcgcccttagaattagttgctagtccttggtattgatacccagtagctgggacattgaccggtagtgtaattggggaagttccggtactactcgatattttcatgtagtagtaatgaccgccatatcgaaaaataaaccaaccaacatttatcagaattgagattattaataataaggtgagcagccattcgatgagatgattagacttagtattcattgtaatattctcctcgtatactactttttaaggcttcgcaatcacattgaaattgcagctgtagaatcttaattaggcagtattttaattgaatttacagttttgaaaaatattaatgaaggtcataattttataccaatcgtaccaagggtattttcttttcctctaagcttattttgtcagtatctaaataataaattgagcttttctccctccaagttagaaaatcgcgggttaaatacaattattattgtaaatgttgcaggcttataagcccacaatttgaactatattagacctattaacttacttttattgtaagtacttagtaaaaggcgttatctattttttgctaatcatttaagaagtctagcagctgcaaatcaagataacgtggtgtcattttgctaaccgacaaagatgcactagctgattttcctgattaaacaaagtgtaaagtaatgcgattgataaattcagcgacgagaaagccaattgcaatcacgccagcaataatgacaacttgtacaaagtactggtaggccaagtctggttgaccagtgaccaagttacgaacgactcgataagactggccaccaggaaccagtgggaccagacttgggatattaaagatgatcatcggcattcgtttgtagcgtgcggccataccgctagcgacgccaatcacgatagctgcgacgaggttaccaatcgcaagtttggcgtcgattcctaatggcaggatgtgatagaggacctcatacgtaaaccagccagcagcaccgacccaaccactgaggttaacggcgcgacgcggaatattgagaagtaccccaaaaccagccgtagctaagtaagctaagataatttgaaataaaccggttgttaagagccaatgtagcatgtcacgcctcctttagtagaaaaatgaagtcagtgcgataccaacaccaatcgcacacgcggataaaacggcctctacagcgcgggcaggaccactcagcaagttacccgtcattgtgtcacggacggcattagtaatggcgacacccggcactaatggcatcacagcgccaataatgatggcgtcgggatgataatgaccgttagtgagataaaagccgagtagggtaattagaccaataataaaagcgcccataaattcgctgagaaaccgaattgaccccagccgattgatccaataaaaggcagcaaaaccagccaacccggctagcccacaagtgatcaagtcggcaggagttgtccgcccagtaaaggcgaccatcaacggcacactaacgacaacggccgctagacataaccagctgaatgggaaggtcggtacggcttgattgacccgttcgagggctgcggcaaattcagttaaatcaatatcgtgattagcaaactgccgtgacaggctgttgacctgatccactttttcgaggtccataccccgattatggattgctcgcacttcgctagtggcattttccggcaaggagacggtaatccctgttaacagtacgaagacctgcgcgtcagggtagcccgcgttggttgcaattcgttgcatcgtgtcttcaactcgtttgatttcagccccattttctagcaaaatggcgccggccaataacgtggtttttaacataactgccgtatcgctcatcaaaacccctcccacatcagaatgtttatattttctcacgaattttgcgtatcgtcattagtttggaacagaatgtttgccggaagtggtcggttatgggtagaattatcttaacaaataaattcttggaggcatttttgatgactgcattgactaaactcaccgatacgtacacgttaaataacggcactaagattccgattgttggttttggaacgtggcaaacacctgatggtcaggttgcttacgattccgtattagccgcattaaaggcggggtaccggcacattgacacggcggcggcctatggtaacgaggaaagtgttggtaaagctattgccgatagtggtgtggcacgtgaagacctatttgtcacgaccaaattatggaatgccgaccatggctatgacgctgccaagaaggcgctggatacctcgttggctaagttaggtttggactatgttgacctctacttgatccactggccaaacccagccgcaatgcgcgacaattgggaacaattgaacgccgatacttggcgggcaatggaagaagcttacacggcacgtaaagcacgggctatcggggtttctaacttccgtcctaagcatttagacgcgctgcttaagacagccaaggttgtgccagccgttaaccaaatcttcctcaatcctagtgatatggaagatgaagttgtggcctacaaccgcaaacatgacattttatcagaagcttatagtccattaggtactggtaagatcttcagtatcccagaattaaagacgttggctgataagtatgataagagcgttgcccaagttgtgctacgttggtcattacaacacggtttcttaccattaccaaaatcagttcatgcggatcggattaaacaaaatacggaattatttgatttcgaactcagcgatgatgatatgaaggtcattgatggtttccacggtgttgccgggttagctaatgatcctgatcaagttaatttctaagtttcatcgttattaaggatgcagccactggcagcatcctttttatttggctaatcacctaattgtcggagtcagctagttaaattagaaaattcgttgttatcgtaaaaagtgtggcgcggccgcttaataatatgaggtaggcccctaattagactaatgaaacgtcataagatgtccgattgttgactagcaacctgactatcacagcgattggactatggtacactcagttttaattattaagtctgggggcctgtgaatgttactgatattagcaattttaccaattgttgtgacggtgggattaggcgtgtttgcggggctacgtcaccaatttgcgccaacgaccagtgatattttgattcagttggtcatgcattacgccttgccgttaagtcttttcggaggaatcttgtcattaaagcgcgctaccattattcaaaactcctcggtagcgctgtggttggcgctaggcatgctaggtggcatggttatcgtcattgtgagccaatgctgtttccatcaacaactagaaacggggacattacgagcgctagtgatcgccagtccttcaattccattcatgggtgtttccgttttactggtggtttttggtaaaatcagtgttttattggtcgcgttaggcggcctgtacatgaatttggtacaagtgccagtgagcgtgttgctgttaacgctagcgggcggttcgacacctgagcaacgttggcgagccggttggcagaaactgtgtcgtgcgagtcggcaaccagtcgtgtgggcgccaatcagtgcttttctcttaaatttggccggattgcggttgcccagtgcttggctaacgaattttacggagttgggacaagcagctgggggcgtggcgttatttgcgctgggacttctgttaacgactagaccgtggcgactgacgcgcatggttgtcttaaacgtgctactgaaaaatttaggcttaccggtgctcatttgggggattatggctagtctaggtgtgtcattaagtaaccaacaattagtcgtcctgacgctcgcaatccccactgcaaccatcgcgaccatgttggccgtccaaaaccacttggcaccagatgagtatgtggcgacgcaaatgttaagtacggtcattgcgccgctgaccatgggattcttaatgtggggattgcagctcgtatgacgggcacattttgattaccatgctgggtttgtgagacgcccataaaggaggtcacgacttgcggtcagtgctgttatgattcccgattgacaaaggttaattggcacggtttaacgacgatactaagccagacgttgtgaacgtcagtatagacaaacccgctcaaatagggcatatttgagcgggtttgtcgcgttagtcttaatagtgaacttgaaaattagtcggttgcgttgcgttgacgacgggatgttgcgcaaagtagtcggcaattaatacggtcatatcagtaggtaagcgccggataatcttagctgtttgatacattgggtaattcccaccgccaccagctcggtaatgattcagagtgactgttaatttttggtcagcggtgactggggccccatgataatcgagttgaacgacacgttgaccaaaaggtttggtaaggtcgaaagtatagtcgatgccactgtaaatatcatagacatagtggcgcaacttagggtgcatgaactcgggattgacccgaacgtgaccgtcttggaggagaaagtaactcgcacaacgttcaagagcggcgcgtagatcagcaccagtaatggcttcaacggcaagtttgtttgggtagacgtaactgttcatgacttcccgcattgtcacgtgttgtttgaggcctggtacgtcgtcattaaataatgctgttgcggcaatatcggtaccggttgcggccatttcaacgcgattaataaaatcgatgtaaggatgattatgcagccgtgcttgaagatgatcgtgtacgagcatattgccgttaatttggccaagtggtgtgtctaaccagtcttccatctggtcattgattggtccaactagttgcattacctgggtattgggggtggcatctgcgaccggatagatttccggatgactggtcgtcacttgatgattgcggtcgagctcaagggtaatcatagcaacattagtacctttcataccaggttgtgtcacgggaacaccgtgaaccgtaacggctaattgtcgatgctggtggccagtaatcatggcatcaatgccgggtacttcagctaatagtgcggaacctcggttttcaccattcatgcgttcggttggacggtcagtttggggatcgcgttcaagaccaccgtggtaggcgatgacaacgacgtcagccagttggcgcaatttgggcacccaatgtttagcagttgcaaccacgtcctcaaagtgcaggccggcaatgtgatgtggttgttcccagtgggcaacgaattgcgtcgttagacccaaaattgccactttaactccggcgcgttccagaattgtgtatggtttggagaataaggtgcggtgcaggtcatcatgaatattagcggccagcatcggatattggcggcttgattcacacaggtcgaggtagtcgagcccgtagttgaattcatggttaccgaaaataccggcttgaacgtggttgcaatttgcaaggcgcgagtataacggtgcagcttcttggtggtggcgagcaatgaaataggtcaacggtgatccctgtacgtagtcgccattatcaatcacgattggccagacatcagccgtatcttcacgtgacagttgatgaataacagtagcggcacgactaagactaaatggtgcgattttatcacgacgactgtagtcagttggcgcgaggtaaccgtgcacatcactagttgagattaatttgattttcataacgtgcctccaaggaatatttgtgttctattataacaatattcatggctggtaacttgattttagtcataaattgaacagttttttgatgatgacctgtggttaatgtttaatggctgctttaattgtacgttctaatcttcacgactttttcacaatttgtacgtaaaacgacaaaatgtttccgctatcattaatagtgacgaatgacaacgataatcgaattacggaggaataaacgatgcagaattatcagaatgcaccattcaaacctacccccgagtccggtttaacgaccacagcggtgacgacccagctaactaaattcggcaaaaatgaattagtagctgcgcgccccgtaccgttatggcgtaaaatttggcaacatatgagcgacgtttcatcgctagtgttattatttgcagttggtttagccacgtacttggctcttgcccagaatgggggctggacaaagaccattgtgattggcgccattttagttattaatgtctgtattggtttgtaccaagaagcttccgcagaaaagtcgttggcggcactgaagtcaatgagtttacccacagctaatgttcgacgggatgggaaggtacaaacgattgcggcaccagaaatcgttcccggtgatttagtgctactaaaagcgggtgaccaggttccagccgatgcggtcgtgttagaggccacgaacttagccgttgatgaggcagttttgacaggtgaaagtgaagctgttgaaaaaagtatttatcaggacaccggtgagttggatgataactgtcaagtgtatgcgggaacggccgtcacagccggtactgcattgattcaggtcttaacgaccggaatggccacagagttaggtcaaattgcaggtttgttgaacaagacgaagcaacgggccacgccattacaggggcggcttaatcggctatcaagctggttaacgacatttgccgtcttaggtggtattacgatttttgcgctgagtgtttgggtgcaaaaccaaggtttggccgatagcttgatgattggggtttcattagcggtcgcggccgtgccagagactctgccgatcatcgtgaccattagtctttcacacggtgttcgacggatggcagacagaaatgccatcatgcgccgagttagtgccgttgaaacgattgggagtgtcgatgtaatcgcgtctgacaagaccggaaccttgacgcaaaatcgaatgacaattacaaagtattggacgccgaccacgggcattatgacgaccgaacagcccttgccatcagcgggacaaacattgatgcgttacttaggattagcgacgaatgccgagattaaccacgttgacggtgaagaacaagccattggggacgcaacggaattagccgttattcgttggctggctcagcatgatttagatcggcccagcttggaggcgcagaccccacgaattgcggaagacccgtttgactcaactaagaagatgatgacgacggtgcatgaattagcgcatggtcgacggttagttatcgtcaaaggggcttgggatcggttaccactgaagcctgaccaagctagcctagctgctggacaagtggcccatgatgaatttgggcaggcggcgcttcgcgttttagctgttggctatcgcatcattcccgcggatgtccaaactactgactgggacgacctgacagctgacctccaattggcaggattgattggtttgattgatccaccacgaccagaagtgattccggccattcgagcagccaaacaggcgggtatttttccagttatgatcacgggagatcatttggttactgcgaaggctatcgctgaggaaattggcattttaacccctgagctgcaagcaattagcggtgatgagttacgccaattgagcgatgaagaattgacggctcaaatcgatcagattgcagtgtacgcccgagtgtcgccgagtgacaaaattagaatcgttcaggcttggcaaagtcttggtaagacggttgcgatgaccggtgatggtgtcaacgatgcgccggcattgaaagcggcggatgttggcattgcaatgggaattacgggtaccgaagtatctaaagaagccgctgacatggtgttaacggatgataattttgcgacgatcatggcagcagttaaggaaggtcggacagtttatcagaatatcattaaagccgttgaattcttggtaggtgtcaactttgcacaaatcttcttgatggttggtgcagtcctcttcggttggggggcgccactgttagcagaacaattgctgattattaacgtacttgctgatgggattccaggattctttattagccaagagccaggtgaaccccaagccatgcaacaaccaccagtagccaatgacgaaagtattttagctcggggccttggtcaacggttgtttatccgggcagctacttttaccgtactaaccctcggaatttacgcgtttggccgctttggcttaacaaatggtcaagccccagtcgggatgacgatggtctttctagtattggcattaggatcaatgatcgacatctatgcaattaaggatcgccgaccactcagctggtcaagcatgacgcgtaatccaatgctgaaccgaggattgctgttaggaattctggtggtcttggcaattgcagtgataccaccgttccgtagtttctttagcttagtgacactaccagcgttaggatggttaacggtgctagtagctacgctgattccaacattcgtgctggaattgaataagcgctggcaggcgcggcgacagtcacgattagtcgtgaatactgctgaataaggatgatcaattcaagttagttaaaatgctgcttacaaacgttattcgtttgcaagcagcattttttcgtgtcattaagttgtgtgcctaaaatactggccggtgagcgggcttagaacgtaagtcatcacaattgtaggcagataattctttcagaccatctttactagcatcgaaataggccgttaatccttgggcaatcattaagttgagttctttattcgcatcaaactgaacgacgatgacgggtgtcttttcagccacggccgcaccgatttcaaacattgtgccagaatctggctcattggttgcactagtcatgtcgaagtcaagaatggcaacaacgacatcggcccgatgaacttgacgcatatcggatgcgtagacgtattgttgccaagcacggctaccaaaaggttcttcttcaaattgatgttcttctgggatgaagataccatcggggttgatcgtcgggttagccaacagcgccgacttcacttgttggatgcgttccttctgagcctcgtcaaaaaacggtgcagctaggtaaacgttattcataatgatttcctttctggataacaaaatttggataagcctattttagcggaaatatggggtggctttcaagccttgatttggcgtgaatcattattaaaaggtgcttatttttggattgctgttcgtcagcaatgatcgtcctattccgacctccggggctgggtgacaattgctggaacgtaagccgacgtcgatttgagcccgtacacaacccgcccggtctcaaatacgagtcttattctaagccggaagcagaccacttccgactaagaataatttggctactgagcattgtcacccagcccctccagtctcaagcttgcgaggggccacgggttgaagccgagcattgcctgccaacggattaatgcggttttggcattagtccattggcgtagcaagcacaggctttagtggcaccgaacacgtttcggtaagccgctcgaatggctgatgaacggccacttaacttagcacaatttatcgttgactattttgatattaaacaaagacaaagggttagggtgcactaggcactctgtcaggagtttgaatcttactatgccgattcaggattaatgagctacctcaatatcattttcagtttgacagttgattaacaaaattactgtttacaaaaagcaacggcaaattcatcaaaagttaagtacagcttcgtctgccattcgaatgctctcccgactggaaggcgtttctgacaatgcccagtggtgaaatttcacttagcaagtgtcctgtgcttggttattgaaaggccagtatttgagacgtgatttttcggctcaagtctgtgcccaccacgttccggcaattggcagaaatgcctggaagtcggtgtaggacgaaccaaccaagcatgtttacgctgattcgaactttttccagcgggcctaagctggctatttttgaactttcaaaataagcaccttttaataatttttgaggcgaataataattagcagagtggatatgtagattataattctatttataataaggtaacaattagatattgttgaattaaaatctaaattgggctaaattaaatagggtagtgaggaggattggatgatggaggaatttggatcaactagtaactatttactttcgtgggaagagttgcccgcggtgcccgtttatatggaacagttgttgcaacttgttaatgaaacaattcagccgctggggttacctgccgtaacgaagacgatgattaatagttacgtgaaacaacattttttcagtcggccggttggacatcggtatacccggaatcagattgtggcggtactagtggtttcaattttgaagactgatttttcattaccagtaattagtaaagcgattttgcaaattcgtgattcgcgtcagattgagccgcggtatcagcaatttcggcaagcattcgagtctacgcttgctggacaaccggtcgtcttgtcgacggttgacccgttagcacgggcaattcaattagcagctcaaacggtggcggcacatttattaacgatccgagcgcttaacgaattggtagattgagttgagataggcacataattgagaatagcgtttgataatatcgctatggctgcttgtagcgtattcgaattaaagcgaattaggcttagcagatatgattaggtatgaaagagagaaagagaatatgacaacacgcaaaaaatggacaattgcgctcattgcattcttgaccgtgatcgtcattggggtcgcgggcggtagtttttatttatatcactttgcatttgaacccaccccgaaagttttgaaccatagttctagtaagagtaaaagtaagttgaagcagaaccaagcgtggctgaaacgggtcaacaagcagacctggcatgagacgtccgcaacggatcatttgaagttagttgcggactatgtaccagctgcgcaccgaaccaccaaaacgattattgtggcgcatggttacatgggtaacaaggagcagatggcgagctatattcgattgtggcatcgccaaggatataatgtgctggcgccggatgatcgtggcaatggtcagagtcagggggattactatggttttggttggcctgaccggttggactatctaaagtggacgcgacaggtgattcgccgcgtaggccaaaatagtcagattggactctttggcgtttcaatgggtggtgcgactgtcatgatgatgagtggcgagaaacttccatcacaagttaaagcgattattgaagattgtggctataccagtgttggtgatgaattgggatatgagctgaatcaactatatcacttaccgaagtttccactgctgtatacggcaagctgggtagctcaagcgaaggcccacttcaactttatgacggcgagttcagtaaaccagctcaagaagaataagttgccaatcttctttattcatggtgctaaggatacttttgtccccacgaagatggtatatcagaactaccgcgctacgacggtcaagtcaaagcaattatgggtggctccaggagctggtcacgcggaatcatacacgcgttatccgcaattatatcaacaaaaagtaagccagttcatggcaaaatatttgaagtaagagctaacggaatagaataactaataaaggtcaccaagcagcgattgctgattggtgacctttattatggttaaaatatgctagtcggattattgtttgtcagccggtccgcgtcctggtccgatctccgggactaagctgatagcttttgaacttgataaatagcgcggttaatcaaccgagtgttttgcaaatgggtgccgcatacttggtataaagatcagtacgccgatgaagttaagcagtaatgacaaggcggtgaagataaagacaccgttgtaatcgaaccagccggagacggcgccaccaagtaaggagccgagcatgctgccagccgcttggaaagattgattccaactgaaaatagtgcctgttaactcgcggggtgtatttttggataataatgtttgcaccgttggaaagagggctccgtcagagatcccaatcatgaagcgcaatagccctaatgtccacacactggagacgaagccttgtggaaagtacatcaggatggcaaagacgaaaccaaagacaaggatacggtcagccccccggtgatcaccgagccgtccgagtcgcggcgccgataatagcgtcgaaattccgggtagagcggcaatgattccagcaacgacggtgattgggccgacgttatgcatcagttctttgacatatagactaataatgggcgtgatggaattattccccatttgaataatcatcgtggagacgagcagtgtgataatcaacgttggatttttaaattggctgagtagactgccgtcacgtttagcaatcggcgcgtcgctgggtttaaagctttcgtggacgagtgtcagactcaatacgaagacgatcagtagcaaaattccggtgataatgaaagtcaaacgaatagagaaaacttgggcgagtacgccaccgagaatcgggccaatcaagttaccagacacgtagccagttgttaggataccgattgcggtcccactactttccttgggagtttcggtggcgattagggcgctagcattgggaatgtagccggcacacaggccttgtaagaaccgaagtagaatgagtatccaaatgttatggacaaatcccatcgcaccgataacaaaggccatcccaagcgaagaacgcagcagcatgattttgcgaccacgccggtcagcgagtttaccccataatggtgagacaacagcgacgacaaaaaaagtcactgcgtatgtaataccactatacatcgtgagttcgtttttggagaaatcccccatttgaccaacgtataatgataagaatggcatgacttcagaaaatcccattccggcgataaatgttcctagccagagaacagcgagattccggcgccagcctgtcaatgcgcccttcacaatctgtcacttccttaattaacttattaagattattttaatgcgaatttaagttttgtgcaattaactaacttagttaaatagacttgaccaagcgtcactaaaaaaactacaatggaaaacattgtagaaagggtgaacgatgtgcagcaagagtcaaagtatcaaatagaagtggtggcgcctaagcaccgacacatgtctaattgggacatgtttgcaacttggattggcgccaatgccaataatggcacgtggtacgttggtggtgtattggctgcgtgtggtttattgacggcgcttaaagtgattgtagcatcgtccacgctatcgtatttatgtttatcgttagtcggcttcatggggtataagaccggggcggcgacgatgagcttgattcgtggttcctttggtgtgcggggcagttacgttccgtcctttgtgaacttgacccagtatattggctggacagcggtaaacacgttcattgcagcaacttctgtcagctatttattacacgatctagttggctggccagtctatggtaaacccggtggggctaaaggactgatcctcggaattattgtcatgagtgtgttgcatttattgagtgtttcggtcggtcaacggtcggttcagatgattgaacgtttaggtattattcttgtcatcttatttgttttatgggagacggtcgtcgtgttccagacggtctcagtgcatgatttgttaacgtggcaggcgccgacacatttacatatgacggcgggtgctgggatggatacgctagcggcgttcaatttgtcttgggtgacagcgggtgctgattttacgcggtttacgcgcaaaaagagtggcgcgactggcatgccatttttaggggcctttaccggcttgttctggttcgcctttatcgggcttgccgcgacgatcagtatcgcgattacttctggaacttatgatcctaataactctgacccgagtaccattgcgagtcgactaggcttgggggtattagcactactggtgattgtcttaacgagtatgacggcgaacgcggtaaacttattggcggctggttcggcgctgtcgaatatctttccacggattcggttacgaccagcactgtgggccgtgacaatcattgccacgttagtcacactgattccattaatcatggggagttttttagctgcatttacggcgttcctagattatattgggatggtgcttggaccgatgatcagcgtgatgttagtcgattactattggcggcatcgtcagcactatgatatcaacgaactggcgagctctaaggggcagtattggtatcatcatggggtgaactggattgcgctattatgttgggtactaggtgtggccatcttcttgttattgaagcacgttgtttggattgcgacggtgactggtgcaactttcattgacatggcgcttatcggggtcatttacgtggctttaatgcgaattttctacccgttacctgccaaacgtgtctaattggattacaatagataagtaaacgaaattagaacgaggggtgtcatgatgtttaaattaactgagatcgatgacgtattaaataatttaggtgaccacgcagactttgccacgattgccaaaaaagaagccgatttgggcgttcaacattttcaatatgatgttgctactggtgccacaacttactttggtgagaacggttatctcgtggaacggcggacgaatggcttagcagtccgggtcgctcgtgaagaagatgccgcggcagttgaacaaatcgcgaagcaatatattgctggccagctggctctagcagacgctgtcaagcagttttccaaggctgggtgtcaagcttggactgctaacttaaaacgccacatcgtcgattttagtggcgatgaaggtaaaatcatggcagctgtaacattctaaatcaataataaagtgcaaaaatgcagactaaccacttttaaccgggtagcctgcatttttgcgttccattaagtttaatagccagcttgatgatattgcttgcttaactggcgttctaagctaagtaaagtcagcggacttagccgccgtaactgatcagagtgatagcgcatgactaattgttcgggactattgattgtaatactagtgacgccgtttaggccttgaaaagcgctttgaatggcctgctggagctcgggatgttggggccagacaggggaggtcagcataactagaccatgttcaggatgttgatacgtgatctgatatttgttgagataacgttgaaacatgtcttctgggttcatgagcaattcctcctcggattggttactagtaacggtgagccgcagtttagtttataacccaaaccagacgacccaaacaaaaaagccagccaggcacaatagcgcaataccaatgagtgcccagatcgtaccgttcagctttttggtgtggtgatagtagtaaatactgagtatgccacacagtatgacaagaatgatgctggtgccaataattaaaccaattgtcaattccataaattactttcgactcctcatattatcattttaattgtgcattaaaatgcgataaagtgcaattatttatcaggattcttagtgtggtaagaacgctaagcattgcatggtgactgagtagtcttgggtggcttgctgatgagaagccacccaagactacttcaatgataatcgatcgtaaaataaaaaaactaggctgcttatgattaacagcgctagttttgattaatgacagttagttagtcgtttttttagacaaacgggttgcaagcaacaaaccggcgagcgctaaaataaacgtaaagtagaacccgtaatgggcaccgttgacgaacgcgctagcagcttgatgacccccattggcgtagtaagaagcttggccaatgcctaataagctcgttgcaattgcggttgaaatggcaccaacgacttgctgtagtgtgttcatgattgtactaccatcggcggcaattggtcccgttaaggaatttaaaccatgcgtctgtgaaggggacatcgctaatggcgccccaatcattaagataacgtgggccaaaataacgtaccacgttgcactctgcgtggttgtcagtgccaacatgagggcaccaaccattgaaatcaagaaccccagcattgctggagtgcgggcgccaatcgagtcatataagcgacccgagacggccgatacaattgcgttcatcaagccaccgggtaacatgatgaccccagtcaaggcaacgggaatcaacagccccttttgaatgtacattgggagtaaatacatggctgataagataatcccaaagttaatcataacgaggcaagcgccaacccgaaaaccagggatagcaaatgtcttaaggttcagaattggcgattccatggtgagttgtcgatgggcataccaagccagaataaccagtcccaaaattaaggcacctagtacagcgggcgacccccaaccttgatcactagcaagactaacgccaacaacaaggctaccaaagccaaccattgaaagtaaaatggataagaagtccactttcggccgggttactttcgcaatgtttttaagtgaagtgacggcaaagataaaggcaataatcaagaatgggataaagagccaaaaaatccaccgccatgaagctagtcctaagatggctccagcaatcgttggacccacggccggtgcgaacatgatgactaaaccgaccatccccatagctgcccctaatttgtagggtggaaaaatctgcatagccacggtaaacatgagtggtaagatcaggccagttgcgataccttgaatcattcgaccgaataataacacgccaaagccaggcgctgaagccgaaataatcgcaccaacggcgaagtcaatcagggcaaataaaatcacttggcgggtcgtaaaccatttggtaattaagcttgaaagtggaaggacgatcccaatcataagcatgtaaccggttactaaccattgcacagttgccgttgacacgtgtagctgagccatcaattgggggagggcaatgttcagtgatgtttcactaaacatcccaacaaaaccaccaattaacatccccatcatggctagcatgggatgggcaacgggaacgcgggcccgttgtttagcttgcgggctactttgtactgaatccattatattgttcacactcactttcctgaatacaatgggttagcataccagaaaattatttttttcgtaagtgttttttctgaaaaaagaggattgatttacggtagtttgaaaaccatcactcaactagtacgtctgtgactgcaattttcggcagtttcattgagcgagaaaggtagcacgtaatggttgttaaaatagtgtttttgtatgtaaataggccacctcagtgtcaaactaaggtggcctattataggtggttgctaagcaaaatcaggtccgcaggcggatcagttatgttcaacaatcgttatgttttcatccaagcacgatggttacactttagcttcgaattggtgtccacattgggggcaagttatccgaacgcgaccatgatgacgcggaatccgaatccgttggtgacactgtgaacagcggaaaacgcggtattgccaatgctgcttgacctggtattttaaacggctgaatgggcgaacaatcggtgaccaaaagcgctgaaagccgcgattgatcgcaacttgctgataaatctttttagagaacaaacgccagtaactaataccgatgagcatcacggcaattaagagtagccacccggtgcgaatgaaaaaactgatgacgatcaatagtaaagcgagattgtttaaaaagcggtttaacgtatcgttttgaccgtaccgcccacgcatccatgatcgtagtcgctgtaatagttttgagtttggtttcaaatgctgaacccccgtcactaaaataattaatatttagtagcataacatagtttttcaacagataaataatacctgtttgtgccactaacggtgtatacttaagcatattacagtaaatagagggaaaaacatgtcaacacaatcacaaatcacgcaaacgcaggttctcgatgctatcagccgtgcggcactgatgttggagcgccaagacgcagcgcaaagcgggttacaactgttgctcaatgaatttcggcggagtttattgcagacgagcggacaggccgccacgacggtattgtatcacggcaaaatcaagagttacctattacaacatccgagcaattatccagatagcgtcgcggcgttatcatcattattagatcattttgttgcggctcagtaattagggccgcttttttgcgccaatcaagttattaacctaactagtgatgatttgggtagtggttaatggcagtcaatgttgatattagaaagaaaattgcgctatgctagatgatgaaccgtgcgagggtgatagttgcttttttacgtttacggttgtaaactacagttaatttaattcgaagggtggtcaaaccattggaagcacaaactaaaattgaaatcagtgatgccgaatgggaagtcatgcgggttgcttggacgttgggcaatgtcacgagtagtcaggtcgctgaaatcatggcggataagatgggatggaagacagcaacggtcaagacactgcttggacggctcgtcaaaaaaggtgcattacgtgctgaaaagaatggtcgagcgttcaattattatccaatggttgaggaacagccatcgatggatgaagccgtggacaccctcttcggtcatttatgtcagatgcgcgttggtcaaacgctggtggaccttgttaaccaaacggaattgagtcaaacggatatcgccgccttacaggcagtattggctgaaaaagccaaggatgcgccagaaatggtggactgcgattgtgtgccggggacgcggtgttaatgtggttataaacgaatattgaagtaacactgagtgtcatgtttggattttcttaatctgaacatgacattttttgaggagaatgattttaaagatacttggctaactgatcatggggcattcgtgcaggccttaatcggaaccatcagttatagtgcgtctaatggaagggacttactttcaagataggatactcaggaaacagatgaatggcgacaaaaagtcaagaaagtgtttttcttgacttttatcgtctacaattgtaaactttagccataaattacagatgtagacaatccgactaggggaggtcgctattatgaaagacatggatatgcaacacatggcgcaccatgattcaaatgacatgggcgatatggatatgggtaacggtgagatgatgcacatgggcaatctcaagttgaagttttgggtagcgttagttctgacgattccgattatcattatgagtccgatgatgggggtcaatttaccatttcaaatcgtttttcggccatggtccgattatatcgtcgcaattttaggcacaatcctgtttctatacggtgggcaaccgtttttcagcggtgccaaggcggaggtcaaaaatcataagcctgccatgatgacgttgattacaatgggtatcagtgtggcgtacgtttacagtatctatgctgtggttgccaatgacttgttaaacgcaaaaccaatggtgaccgatttcttctgggaactagcgactttgatcgtcatcatgttgttaggccactggatcgagatgaatacggtcatgaatgcgggatcggcggtagataaactagcaaaactgttaccaagtacggcacataagttagttgatgggcaggtccatgacgtggcaattgctgatctagctaatggtgatcaagttcaggtccgggctggtgaacaaattccagctgacggcacagtgttaaatggtgcgactagtgtgaatgaagcgatggttactggtgaagctaagttagttgaaaaacgcgctaaggatcaagttgtgggtggttcagtcaatggtgatgggacgtttgagatgaaagtcaccgggactggtgaatccggatacttagcccaagtcatgaagttagtcagtgacgcacaggcggccaaatcgtcgcaagaaaatatggcggataaagtggccggactcttgttctacgctgccttgaccgttgcaatcgttgcctttatcgtctggttactcgtgggcaatctggcgttagcactatcaattgcggtgacagtgctcgtgattgcttgtcctcacgctttaggattggcaattccattggtagtggcacggagtacggcgattgcggccagccacgggttactgattcgtaatcgggatgcgatggaacaagtcaaaaagttgaactacgcgttgatggataagaccgggacattgacagctggtaactttaaggtcgctgattatcaaagtagcgccgaccggctaactgcggacgcagtcttggcgatgatggccggtttggaaaatggctctagtcatcccttagctgtcggaattcttgctgccgctaaggaacatcagttaacccctaaggttagtcaggatgttcatcagattactggtgtcgggttaagcggcacgattgatgggcagacgtatcagatcgtttcggcagcttacttggataaacaaaatttagcctatgaccagcaaacgttcaatcgactggcaagtgccggtaactcagtcagttttttgattcaggagcagacagtcttaggttttgtcgctcagggtgaccagatcaagccggaagccaagaacttgatcgatagtttgaaggcccaaaacattaccccagtaatgctaaccggtgataatccgcagagcgcccaagtcgttgctaagcagctcggaattacagaagtgcatgcgggtttattgcccgaagataaggctaagctcgttcaacagtatcaggctgatggtagccacgttatgatgattggcgatggtgttaacgatgcccctagtctggcccgggcagatattggcgttgccattgggtctgggactgacgttgctattgattctgctgatatcgttctcgttaagagtaatccaaatgatgtggtcgatttcttggctctggcccggcgaacgacccggaagatggcgcaaaatttatggtggggtgctggatacaatgtcatcacaatccccttggctgctggtattctcgcaccactcggctttattttgaacccgatgtttggtgcggtagtgatgtcattaagcacggtaatcgtggcaattaatgcgatgacgttacgattaaaagactaaggtaaactgattggcgtaaattaatttgtgcaaatgtgtgtttataatgggtttagatgctagaataatagtatttaaatcaaggatgtgaaacccatgtgtactagtttaacgattcaaaccacggcgggtgatcagtttttagcacgcaccatggactttgcttttgaacttggtggtcgaccagtggcaatcccacggaatcaccactttgacagtgttaccaatgcggacggttttgatagcccgtatagctttgttggaacaggccgtgacttaaatggctatatctttgtcgatggtgtcaatgagcacggggtcagtgcagctgcactctatttctcgggacaagctcactttactcagcagactaaggctggcaaggttaacttggcaccccacgaagttttaatgtggattttaggaaacgtgaagagcaccgctgaattaggcgaacggattgctgacttgaacgtgatggaagccgccgcaccactattgaatattgtggtaccactacactggatcattagtgacaagagtggttctacttacgtcttagaattggaaaatgacggtgttcactacatgaagaatccggtgggcgtcatgacgaacacaccagattttgaatggcatctcaagaatttgagtaattacgtcaacttacaacccggccctcatcctagtcgtcaatacggtgacatgacggtgaatcctttcggtcctggaactggggcgttgggaatgcctggtgactatacgtcagttgcacgcttcgttcggacggtcttcatgcgtgaacatacggatgaagtaacgactgatgcagaagctgtcaacgcattatcacacatgctgaactcagtggagattcctaagggcgttaagatgcaagataacgggacgccagattatacccagtaccgcgcctatatgagcatgaatgaaccagcattttacatgcaaccatacgcggatcagacgattacgcgggtcgaattgacaccagctttaatgacggccgcgcaaccgactgaatttgaattaaagacaacccaacagttccggttagcaaactaagttggaatatattagggtcaaaatatgaaagcagcaccgttagcattttatgctaacggtgctgctttttttgattctaggcagaatagcactttcaatgacctataataattattcaaattaactttaataattaaatggtggtacactatattatagtttagggatacataacttatactcgataatgattacaaataagccttgcattttctttctgaaagatataatatttactaggtaataatgattataaagtatctacggaggcggcaaacatgaaaaaaaggatgtctttggcacagcgggttaatattttgcgagcaagtgtcatgggagcgaatgatggaattctatcagttgccggcattgttgttggcgttgcgggggcaaccaccaatagtttttcgattttaatatctggactagccgggatgttggctgggacgatttcaatggccatgggtgaatacgtctccgtgaatacgcaaaaagattcacaaaaaatggcgattactaagcagaaggcagcacttgccgatgattatgaagcagaagcgtcgctagtcgtacaaaaatatgtcaatcaaggaatcagtaaaccgttggcgcaacaagcaacccgggaaatgatggcggaagatgcgctgactacgacggtgcgtgagcgctatggcttcaatccgaaccagttcatcagtccgtatgcggctggtattgcgtcgatgattgcctttcccactggctcaattttgccattagtttcgatcacctttttcccaccacgggtgaaggtgttagcaacggtgttggctgtcggaattgcattaatgattacgggatacgttgcggcgatgctgggtaatgctaatcgtcggcgcggaatggttcgtaacgtcgttgccgggttattgacgatgatcgtaacgtactttattggtcacttatttgcttaattaaagggtcaaggggagcgagcttatgcaactgacaaggacaaagtctgagaagaccaaacaaacgatggatgagaagttaaactcattacgagcaggtgtcttaggttctaatgatggtattttaaccgttgtgggggtgctgtttagtgtggcggccgccacgactaatcagttcacgatttttattgctggattatctgatttattagcctgtgctttttcgatggcgtcaggagaatatgcttcggtcagcacgcagaaggatactgaaaaagccgtggttgaaaaggagcggcaattgctgaagacggattttgagggtgaattgcatgctgttcaacgccactatatgactcttggcgtgacggaagagacggcgatggcgattgcacgcgatttattaactaaaaaaccattggcaaccgttgtcagcatcaaatatgatatgcaactaggacactatatgaatccttgggatgcagcgtttgcatcgctattctcagcgtcagcaggaggcgtcttcccgttgctcgcgatgacgtttgcaccggctcattggcagtggccggcaacaattatcgcggtgtccgttgccgtggccttaacaggatatttatcggccgtattaggtaagggcaatgtgaagacggcggtgattcgcaacgtgctcgttgggatcgtgacgatgttcattcactactacgttgggacgctcttttaagcacttctgtcctggtcagttcggactagggattgtcaacagtgaaacaatagctaaccaaacggcacttgaagtacggtgtgctggaaacggcatcagtatgggcacaaattgttaggatcggtacgaacttaaatagcactggggcgggcaattactgtagttacccgccccagtgctatttagttgagggcggtttccgtgtaattgcgcacaataagtaataaaagttcggatttatcgttgcttatagatgatagaacttgattatgataaagattactgaatcttcctaaaaaacaacgctcgattttcagtgagttttaattaagtctcggtataatattgccattaattaaattgaggtagagcgaaattgaaaaatatgacaactaaccgttatatgaagggcatcatgtgggcgatgttggcctcgaccctgtggggagtctcaggtacagtgatgcagttcgtatcacaaaaccaagccatcccggctgattggttcttatctgtaaggacgttatctgctggaatcattctgttagcgattggatttgtgcaacagggtaccaaaatcttcaaagtctttagatcttgggcgtcggttggacaattagtggcatacgcgacagtgggattgatggcgaatatgtatactttttacatcagtattgagcgcggaacagccgctgccgccactattttacaatacttaagtcctttgtttattgtactaggaacgttgctgtttaaacgggaactgcctttacggactgatttaattgcgtttgcggtctccttgttgggggtgtttttagcaatcactaagggtaatattcatgagttggcgattccgatggatgcactcgtctggggaatcctttcgggggtaacagcggccttgtacgtagtcttgccgcgaaagattgtagccgaaaattcaccggtcgtgattcttggttgggggacattgattgcgggaatcctatttaatttatatcacccaatttggatcggtgcaccaaaaattacaccaacgctagtgacttcaattggcgccatcgttttaatcgggacgatttttgctttcttatcgttgctacatagtctacagtacgcgccgtctgcggtggtcagtattgttgatgccgtccaaccagtagtgacttttgtactaagtattattttcttaggcttacaagtgacatgggtcgaaatcctcggctcgttattggtgattgtcgcgatttatatcttgcagcagtatcggagtgatccggctagtgattagttgtaatgatagttatcatttttgtttagttagggcccttgaataagggctcagcaggacttgaccatttgtgaaatgaccaaaaataaaagctgcgtgtcagaattttaacattctgatgcgcagctttaatcataatttgagtagattaaagttatcttgggggacgatggttggtaagttgtgctacgccaacaccagtttccgggcgggggcgtgcattttaataacttcggcacccaggtcaatataaggctgaccttccgcaatcaatccgaacttctcgtaaaacttctgggcgtgcgtttgggcatcgatttcaatggtggcggcgctgtaatgcactttaagaattgccatgacgtgattcatgagttgcttgccaaggcccgtcccacgatagcaactgtcagtcgttatccggccgaacgaaacgaccccagcatgttcgtaaattcgtgcataagcgacgagttgcccctgatcgtaggcgaagacgtgacgcgcgtccaagtcagtatcatcagggtcttggtaagaccgatcttgttctttaataaaggtcttggcacgaagttgataaatatcgtgcagttgggtggtggttagaccattaaattgcttaacgtaccatttcaaattcaagtgaaagcctccttgaaaactgaagaatatcgccagttattttcaaattgagtctataatttaacacttgtatttttgaccgtcaattgcaaagacccgcgatttatcaatggttacaggtattacttttgatgaaaaaaacatgagaacggattgctggttataccagtgaattgatagcttgattatcagtcatcgttagttaactgtctagatattatcatttttctcataatttgatggataataaaagaaccaccacgcattgcctattgtggtgattctggttgatctttaaattgtttttttgacggcctggtaattaattaataccaagcaggtttgtcaccatcggtattaggtttgttaacacctaaagacgtgcgaatgttacttgtgggatcttgggttaatttaacgacgagtgccgcaatgctcttacgagaaacttcagttcccttaaacggatcgtgtcgctgggttatttcgtagtcgatttcgtccttattagtcaaccacgcagggcgaatgattgtgtagtcgagatcggaattttctaggacttcagccgcggcgtagtagcgcgtcaggtagctacccaacgttgcgttgttccattgaccgaacttgccgggaacttcgtcatagatccctaaagttgagatccaaatgagccgtttgaggccgctggtatgcatggcttttaacactgtttcagcctgctgtttgatgttttgaccagccaaattagcataaacgacatcttgtcccgtcatcgcctgggttaatttggcttcatcagtcgtgtcaccatcgataatcgtcacccggtcagattgttggtctgcgacccggctactattacgtaagtaaagtgtcaaattatcagttgtgttggctaaaaattgctgttcggctaaacgagcaatttggcccgcagcccctaagatcaatacatttgtcatataatcccctcctgaacatcttaactgtaaacttaattattacagaattcaagtaagcagtttcaaaaaagttaagcaaatttgtgccactttttgaatttagacttataatgaacatgtagcgaagttgtacttcgctgtccaagataaaagaggcgatagtcatggcacaaaagcttagcaaggaacaaaaaaaggctatgattcaaaaagccgaagaagaacgtgcaaagcatccaaagaagaagagtggcgtttccggtttcgaaacgatcgatgaagatgctaaaaagttatctaataactaataattagcgtgattcttcagttagggcgagacattggtcgcgcccttttattttgtccaaaatgagtgcacgggatcgcctggtgatgattgactggttcgagcaaaattgcagttggcacggagactgatggtcggttgttagcaatgctgtgacagccatccatttgaatagctgtcacatcagtcttgcagtataatagcggtaattaatgatgggggtgacgcaaatggatcaatttacagcgtttatggcgcagcttgataagacgttggcacaagagcaattatcgtctactgatctggtgtacgtgccagtaacctttagcttccataatcagcgcttacaggttgccattaatatgctccaaacttcatttaatcagggtaataatgtatttggggtgcctgatattctggatcgaatcagaatgttggtcggtttggaattagctgatcgcccgcagtctcgctggcctacgaagatgacgacccagcaactaacaatcacgccacataaaatggtcagggtgatcccagttgatatgcgggcatatcaagtggagtgatttagcactctgatacggagagtgctaaattgttgcaatcttgatgaaagtgcttattattaatgatgtaaacaaattgaaagggtgatttcataatggctaacgatatgatgaattggcacaatgatttatttgatcggttgaatgactggactaagatggacgatttggttaatggattcggtcggacattcttaaatgctggtagtcatgggtcggtcctaaagactgatattaaagaaaatgacgatcagtacacgatgaaagtcgatattcctggaatcgataaacagaatattgccttgaagtatcgggatggcacattatcgattgctgtaaaacgcgatagtattagtgatgaaagcgataaagatggtaatattatcgcgagtgaacgtcaaactggtcgctttggccggcaatattctttacccgacgttgatgttgacaagatcgaagcacgatatgaaaatggtgtgttgcagttaactttgccaaagaaggcagctgcggatacccatcatattgaaattcagtaatggtttatatgacgacttgccgcgattggtggcagggcgtctttttattgtatttatagcggatgaaacggttacaaaaatttgtaaatttttgatgaaatctggagtcagatactcacatctttgctggatttctggtacaatttaatcctatcgatatatcaattgaactgaatattgataatgataggatatgtttgttgtcggatttgtaagaaagtaggaatgcgtgatgacggaaggttttagaccgagtcaccctaagattgagattgacgatgaccctggaatacgggctcaaatcgaagctttgactggtgaactctcacaacaacaattggctaaatgggcgttaattatcgccaagaaagccttgcagtatgttgataaccaacagaaatatgatcgacaattgcgactcgcaattgatgctaatgaattgtggcaagttaatcttgttagtggctaccaggtacggcaggcactggcacgattgactaagttaagtgcaacgacgacgagttccattggtgcggcggcactggactgcgttcgctgggccgtagcttccgcagatgcggatgaaaatgcgctgcgggcctcggaccaagcaattaaattggttaatttaacgcaaccaaatgacatggttgcggtcactgccgagcgtcagtggcagtacgatcagttagctggattagcagctaacattcagcaggggttacgccgtatgctataatcttcacagagattaaattaggtggggatattttatggcaacggtacatgcagaagcaaaggcggagttgttacgtcagtatcaagaaattgtaacgaagtatttaacgaatatttcggaaacagtggacgtgaaggcgcattttgaattaaaaaacgaaccaggatttaattattttgtggattatttgtttttagccaatgtttgttaccaagcgagtctggatattttgaataatgaagatcaaaaatatccagatattaataagcggctagcagcggtcatcttaaaataccccgagtatttgacattggccgttttcaatgccgatttccaggatgaaagtgtgacggatcactacgaaaaaacactcgtagatttggctaacactttggattaatttgtaaataaggtggtcacgaacttcggatagacgaagcctcgtggccttttttggagggttagtaatgattgaatgggatgcggcaacaattaaagattttcagacgacgctattagattggtttgatcacgaaggccgcgatttaccatggcgacatgaccatgagccttaccacgtctgggtctctgaaattatgttacagcagacgcaggttcaaactgtgattccttattatcagcgctttatggcactttttccaacggtagcggacctagctgccgcacctgagtcacagttgttaaaggcgtgggagggcctgggttattattcacgtgtccgcaatatgcaacggtgtgccaaacaattgttaaccgattacgatggacagtggcctcaaactgccgctgagctgacggagttgattgggattggcccgtacactgcaggagcgattgccagcattgcgttcaatgaaccagttccagctgtggatggtaatgcctatcgcgtctttagccggttgctcaagattgatgcggatattgcgaagccccagacccgcgctgtttttgaacgggtaatcagtcagattatttcacaagagcgacctggagattttaaccaggcgattatggacctcggttcaagctacatgacagcgcggcaaccagatacggctcattcgccggtcaaacgctttaatcaagcttatttggatggggatgagttagcctatccggtcaagacgaagaaaccgcggcccaagccggttgcttacgtggcggtattagctaagatgcaggatcagtggttgatgacgaagcgaccgagtaacgggatgttggctaatttatggacggttcccttgattccgattgcagatttagacttagatgatgattaccaacctgaagaactagttacggcggtagaaaattattttaaacgtgaatatcagctccagctaacggcccattatctgaccgggcggcctgtgacccatacatttacgcatcagaagtggaccattcaaggtttgagtggtcaagttgggttaagtgacttagcctactttgctggtcagacctttacgttgattgagcggcagaaacttccaatgcctaaggttcaagaaaaaatttttgcacgctattcaattgattaattcagtcaacattaaatacttttcacccttcagatgtgctatggttgtggtagaatatagcaaatcaatattgtgacggagggtcgcgcatgttaaatgtatttgatatcgttaagttaacaaagatagaccataaagaagtcgacagtaatcaagtggttgttacagatggtaacggtaagcccaatgcgattttgacagaattattgaatgatgttgtgggaaatatgcggatctttattaacatggaagatgtttattcggtcgatgacttaatgcgcgcattggccgcccatacgccattgccacaagatgtcttagaagaatatgaaaaggtattgcgggaaccgatttataacattaattttgtgccgaaaaggggccaagttgaagttgtgatcggtgaaggctaacgtgattgtcataatcatgataagatgttagtcaactcattgtgatgaaaatcagggccattcgtgggacctgatttttttgtgctgaattgatgatagtggctgtcacgaggactgatcaatatgtggttgcgggaaagtgttggttcgatttaacgataccggcacctgcgttataatggagtcaacttatggtcatgaaatgtgataggttattgtaaatggtcatagattgtttaccgcatcgtacgataggaggagtgctcattatgcaattaaaattagaacggatttacacgaaaccagttgatacggatggttatcgggtgttggtagatcgcttgtggccccggggtatttcaaaggttaacgctcagttggacaattgggtaaaggaaattggcccgtcgaccacgttacgtaagtggttcaatcatgaaccggcgaaatatcccgaatttgtcgatcgttaccgggctgaattggatgagaatcccctgacggccagctttattagtcaagttgctgaacaactgacgaagacgaatgtgatcttattgttcggtgccaaggacgaacaacataatcaggcagtggtactgcgtgattacctgaaggatagtgggcaattaccaaccgcttaatataaattgcgtaatattggtatagatgaaattgggattaggcctgcaataaactgcgcccatcaaattattttaattattttttgaaaacgctagcaattagctgcgaattttgctatgattatgttgttaattaatgacgtcaactattacagtgcacaataatgggggctgcattgttaggcaagcaagattggggataattttatgataaacttatgtgtgttgccaagtaccgcaagttgtcgcaaggcccaccggtggttactcgaacaccggatcccgtttcatgaacgtaatatgaatgcacagccgttaacagagactgaaatcaagcacctgctacagtacacgtacaatggcattgatgatttgatcagtactaagtccaatgcttatcaccaactgagtaagacgacaccgattgaagatatgccattaagcgaagctgttcgggtattaagccaaacaccgcaattattgcggcgaccaattatttttgacgatcaccgacttctgtgcggctttaaccaagatgagattcggatgtttattccacgtgaacagcgcgtactcaagatgcaagcaatgtcagaacatcagatggcttaaaatgatcggcttatgagttgatgccgtgtttttggggcgaaacattataaaacagtactacttacttgccagtataaactgattggcacagttaagcggtgctgttttgtgtgtaaattgacaaattacagctatttagttagtatactaactaaatagtggaggatgaaatggataatattggttatttactaatgcagttttccaaacagttacgttatcagctaaatcaacggctaattgctaacggattgacgattcaacaatgggctgtgatgcaacaaatcagtctttgggtcgaaagaacggcgcaacagccgactgccaaccagctgtgccacgttctcgatatggaccggccgacgatgtcaggaattcttcgacgcttagctgccaagcgattggttgaacaggacgttaatccagcggaccagcgagcaaagctactacgcttgacccaagttggcatacaagaattgcaggccggccagcgtattagcgatcaggttgttgcgacggggcttcagaaattgacggctgctgaaaaacagtctttaagacaactgttaaaaaaactagggagcaattaataaaatgaaaatactggtgataggtgggacgggaaatattggcttaccgttaattcaatatctagatcaacaggtgggggtgcaagttgttgctggtgcccacaacttacataaagacgagcaactattggctgcgtatccgaacgtcgaaattcgacgttttgattttttagacgagacgacctttgatgcggcgttacggggaatccaaaaggtgtttttcgtgcggccaccacaacttgctaaacccaagcaagatatgtggcccttcctaaaatgcttacaagcacaccacattgagcaggtcgtatttgtttcgttgatgggtgttgagcataatccaatgacgccacatcatcaaatcgagcagatgatcgaacagttacagttaccgtacacattcattcgaccgagcttctttatgcaaaatttgaataccacgcatcgcgtcgacattcagcaaaatcacgatttgtttatcccagccgggcggtcgaagacgagttttattgatacacgtgatattggtgagattgcgggcgtggcgttactagatacacaatatttacaacagaaattgactgtgactggtccagaagcgttgacttatcagcaaattgcggcgctaatgactgaatcctttggtcacccggtaacgtatcatcgaccgagcttatggcggtttcgccgcgtgatgttgaagcggggaatcaagaaggactatgttaatgttatggtaatgctgtatttgattacccagttgggcaacgctaaacgcgtgaccgatacggctgaaaaagtgctgggtcacgccccgcatacgatgacaacttacttacgagattatgcagatcagttacagtagttaggtcgaggagtaggcatgtcatttggcagttgtgggttaatttagtggtgagcatggtcaacaaaaaaacagttacctcattttgaagtaactgttttttagcggacatatccagtacagactagctaattcaagcaaacaggcattgaagtaggatgcctgctgatttttataggcgataacgactagcaaatacaatgcttaggcatacttatgtgcaattttagccgcaacggccgccgcgatcgcaccaactaggtcatcaataaacgtgttaacaacgcctgacttatcagtatctaacttcttaatgacgccttctttaactttatccacgtaaccataattagtgacgccgatggtgccgtaaatattcgccatattaagtgctaagccttcatcaacaccgaagacgccggcgtcactggcaatgatagattggagcggctcgtttagctggccttctgtggcaaggcggtcgagttctaacgcaaccatcgcattgttcaatagttcgcgcttatgcagtacttcttgcgtctccatttcgcactcttcgattgttaagttagggacgtattttgtttgtaagttataagtgatatgcgcaatttcatgataagtaatcccttttgcggctaaggcttgaatgacgaactcatacgcagccttatcaggatatttaaacgttggtttttccatagttaccctccagaaataaacaatttgagtaggttagttatttaacctagtaagtccattataacgagatgagtggctaaagaatatgatttgggttcaatattcgttggtgcgggttaaaaaggcgattgttgaaaacgatgactggttattttaattgaaacgcgtaaaataagactgttaaacataatgaagggtaagataattttgatgaaacgttggcgaacggtgattcaattgttattgattgtttttgttgtcggtgcggctgtgattttagttggggcccggaatcatgataccaagattacgaaagtaacgagtcaattgacaccgcgttctgcacgaatattaaagaatcaatatgaccagtcaaagacagcgacggtctttttacatggctacaatggtggggcgtattcgacgaactatctgattcgtaaagccgaaaaagcgggggctgcccaaaaagcgttagtggtgcacgtgtacaagaatggtgtgatggcctttaagggttattggcaaaagtcaatcaagaatccgatggttcaagttgtttttcaagataatcacgcctcacaaaaagcccagatctattggttacaccaagtcttagtccaactaaaagcgaagtatggcgtcaaagcttataatgcggttggtcattccctcggggccaatgatattgtcaatcaggcattgaagtatgggcatgacaaacgcttaccaacgttgaataaaatcgtgacgattggcggaccgttcgatggcctgaccgggtttctgagcacgcagacggaagcaacggtccggcgcttggatgttaaaccaagtcgtttcacgaagcatttttcagaaatgctcaagtatcgccacaattttccagacaacgtgaaactactcaatgtctatggagatacaaacacggggtataacaatgatggttttgtgggtgtcgcttcagcgcgctcaattcggtacttgttgcgcggaaaattagcacagtatcaagaagctttctacagtggggaacaggcggcgcattgcgcgttgaatcagaatccaagtgttgctcacaagatgattgcctttttgtggtaagtgttattgtgtcaggatgggtgcattaaataaatgaggtcgttcgagtaaatactcgggcggctttttttgtagcgccaaattaggcggtcaaacgcagcaactacagctttggtgacgttttcgataaggaagacagctttagaaaacaaagtattgcgacctattcgtcgttaaaaacaggggttgatagttaaaaatcgcaattaagtgaaagttagagcgtgctataatgacacaacattaagatttaacaacaaagtcattaaaatttgtggaggggtcttatgaaaataactaatgctgatggcacaatccgggcgcttagtaaccggcatgtccaaatgattgcaattggtggcacgattgggacaggattatttcttggttcagggagtacgatttcaaagacgggaccgtcagtcatgtgggtgtacttggtgttgggcttcttcttctttttaatgatgcgggcaattggtgagatgttctattctgatcctacccaacacacattcgtggcgtttatttcccgctatttgggaccgagtgttggtcattttacagggtggacctattggatcggtttgatttttgtctgtatggctgagctgacggctacggcaacgtatgtcaaattttggttaccaaatgtccccgcctggctaattgagattagcttcctgttaattttggcgggcgttaatttaacggctgcacggttatttggcgaagcagagttctggtttgcgatgattaagatcgtcgcaatcattgcactgattgtcactggtattttcatgatggtgggacatcacccaaccccattaggccaggcttcaatcggcaatttgttccataattatcaggtctttcccaatgggatagctaactttatctcggcatttccaatggtcttctttgcttttcagggcattgaatttgtcagtataacgattggtgaggccaagaaccctcaccgcgttatcaaaaaggcggtcaatgaaactttgttgcggatcttgttgttttatattggtgcgttaattgtcattatgggcattattccgtggacatcactgtcacccgatagcagtccgtttgtgcaagtcttcaagttggcaggatacccagcagcggccgccatcattaactttgtcgtcttaacgtcggcagcctcatcgctaaatagttgtttgttctcagctggacgtcacttctatcagctagccactgaaatgccagttacgagtcgcatgcaccaaatctttggtcagatttcgaaaagtggtgtgccggcagcagcaatcgtgttgtccgcggtactagtgctagtgacccccatcatgagtttaagtgctgcaacgacggcagtttttaccgtcgtgaccgggatctctagtgatatgtacctgattgtttacacgctggcgatgctggcccaccggaagtaccggctatctaatgactatctggcggatgggtttaagatgccggcgtaccgaatcacgagcccactgacgattgccttttttgttctcatttttgccagtctattcttcattcaagctgatattgtcggtgcaatcggtgcgattatttggacgttactatttggtggcatcacttttgcccaccaagcgcgcttgcgagctgtaacacggtcgtaatcttaaaatgagaattatattataaaatggcttgacgatgataaaagatggtggtattgttaatcacaagttaataactgtacgataacgttacatcaagtagacatagtggtaggtgtcaggaagccggtggttgctgcgaaccggtcagctactatgattgaaatacggtaaccgagtttcgactgaacggataataactagaaccgttatcttctagtgagtggtggattaagtgtcaataatccgcaacctgggtggtaccgcgactagtctaatcgtccctgttgttcatatgaacaatggggacgatttttttgatgaagaggatgagaataatgacaaatcaacgctgtggtgggattgcacgatattaaaattttgatgatgaatatgcgtcactggaattttatcaatcgaaggggtaataaattatgaacaaaacaaaagcaccacaaattagtaccttagaagcagtcattgtcttactggtcgtcctcggaattatgagtgcgggtgtgattggttggggattatcgccccaagttcccgtattactcgcaatgggcgttgtcactgcttgggcgatgttgcgcggttttccatggtcagcagttaatgctgggattaaagagggcattgataaagggatcgtgccaatcttcatctttattctcattggtgcgatgatttcaacttggattgcggcgggaacgattcctacgctcatggtgattggattcaaaattattaatattcagtggtttttgccatcattctttattgtttgtaccctagtcggtgcggcggtcggcagtgcctttacggtaacatcgacggtcggaattgcctttttcggcatgggcgtgaccatgaatctgaatccagccttagttgccggtgcaattatcagtggtggaatcttcggcgataaattatcaccattatcagaaaccaataatttagcttcagccgtagtggatactgatctttttacgcacattaagcatatcttatggagcacgctaccggccgggctcatttcattaggcttgtttgctatgctggggcacagtaatacggagacaagcttagccaagatcaatcaaacagttgcggttttaaatggtcatttcagtatctcagccttggcattgttaccaatcgtcttagtcttcatttgtgccgggtttaaaatgccagccattccaacgatgcttttaaatatttttatttcggcgggcttgattctatttgaacagcctgagttatcactggcgaagttaaccgccattattaacacgggatttgtttcgaagacggggaatacgagtgttgatacgttgctttcacggggcggaatcgtcagcatgatgagtatggtcgcgttaattgtggttacgctatccttaggaggattgttggtcaagtttggactgatcaatcaaattatgaccccggttgctaagcacttgaatagcgatggcaagttagtattggcgggtgtattaacttgtattggtgtcaacgtgtttgttggtgaacaatttctttcgattatcttaccagggcgcgcttttcgccaggcattcaatgatggtggcttatccggaaatgcactggggcgggtccttgaagatggcggtacggtgatcaattacctagtcccgtggggcgttggcggcgtcttcctgacgacgacgctgggagtaccaaccgtccaatacttaccgtttgttttcttcagtttactttgtccagttatctcggtaatcagcggtttcactggtgttggtatggcgcacttgaatcagcgaactgcagtgaaaactaagcatgtgactgcgacggaagtttaatcgttggtcgatcagttcactttagggaaggttgacgaatggctgttaaaatagttactttatgtgggtctagaaaatatgcggcagtatttgaaacggttgagctggctctgagtaaacaaggtgttattgttttaaagccagctttcagtgatgaagtattaacaccgattgagcttcagaatttacgccagacacatttgaaaaaaatcgacttggcagatgaagtagtggtcattaatgttgctggctacattggtgagcggactaggcaagaaattggctatgcacagcgtcaacataagagaattcggtattacgcagttacggaaaacgagcattaattaaaatgaccagtatcgaagaatatcgatactggtcattttgcgttgatttagtaatctttacttgagtttagtagccgcttgaaaatctgcgtacatgggatggttcaaattgatcccgcgtgatttggcaatgaaccaagctaagacttggaacgggataatcgcaagtagtggggctttatacggatcagcaacggcttcgagctggagggtttgatcatcattgacggtcggttggtcaccagtgagactgatggtataaatgtggggcgttaatcgcgattcgtacgtcttgacggcctgtaattgggtcatgacagccgggtctgtattgatttcaagatagaactgacagtgatcttcatgcgtccccataaagccaccgtgggtaaatgaggctaatgagtaaccatgcgttggtacccggaggatttcggtgaatttggcttgcatttcagttagtgttccagctaggacgttagcaccgatagctgtaaattgaggggcgttagtgaaatcaatagtgaacttacggtagaagtcgttcgcccgttgaacagttggattcatgctttcaatcagaaaactgaattcgtctaattcttgattgactgctaattcggttaaccgtgcttgaagggcagcactgcggacggcaagcaacattaaagtgagcacgatggcttgaaagcttagtgtaatatagggcactgattctttgccagttagtaagtcacaagttgcatcggccattgcggtcaaagcagtcgatttttgattagtcacgataatgacatgagcttgactggccgtgtgggctttttcgattgccgcttgcatggttggatcatcatcttttagagaaatcccgataacaacatcgacactgggatcggcttcctcataagtgacgtagaggtcggccgcagcaatggtcacttggagggcggccgtcttttgcatgtataagcgggcggtgttggcggcgttgagtcttgaaccagttgcgaggatcaaccagtgttgtggatgatcaggggtggcagtcaaggccgccgtaatctgtttgggataattggttaacaaccgctctagtactggctgttcccgacgaatgtatgagagcatggtcggattattcatcatcatcaaaatcatcagctcctaaaaaaatagttatgtatattaatttagctttattgtaaacgtaaatgaacttatagtcagcaaaagaatgtttaaaaatatgactgttgattaatcgtagcgggtccgctttaaatcaaaggcgactgctcgcaaatcatcataaaagacgacttaacggccaacagttttattcacgggcttgccattatcggaacatgttgcgtttcaatgtacgcagaacaacgtcctaatcagcattctggttagatggcgtcaccagtaagggaccttgtcgcaaatcgtatgccgttcatttaaaatgccagcgctgtttgtggcagacccgacattgatttaggtgaatattcatgtctagttctaagttcattgtaccaatcatttatgataattagggcttgcatgtaactgaaaaggctggtaaagtaaggaacaatttatcaatacaactaattgcctatataatgccatgatatggatggcgagtttctacccagtgccgtaaacactggactataagcgaattgagtcgacgggtctacactgcttaatttgccgtgtggacccgtttgctttctccgtaggcagactgactagtgaggagaaaataacgatgacgaagacagttgaaatggtgattactggtgcacaagtgttaaacgtttatacccgtgaatttgaagccaccagtttgtggatcgatcacggccggattattagtaacttgcgtgacgagccgtacatagcggcccagcatgtcgatgcgaccggtcagtggatcgttcccggcatgatcgatgcacatgtgcatatggagagttcgatggtggcacctagcgagttgggaaaagtcttactacagcacggcgtcacgacaattgcgactgatccacatgaacttgccaatgttgcgggtattgctggcattcagtacctaattgatgatgcgcgccaaacaccactagatgtctgttttatgctaccgtcatcggtaccgtgtgttccctttgatgataacggggcaacgctacatgctgctgacttgcgcccactttaccaacagtcggaggttcggggactggcggaagtaatggactatggggccgttgcgcgtggtgatactgacaccctggctaaaattagtgatgcctatgcgtatggctatcatgcggatggtcacgctgccggtttgaatgcgcatcagctcaatgtgatgcgcaatgcgggactggatactgatcatgaatgtatgacagtggcggaagcacaggatcgtgtgcgggctggtatggctgttttcttgcgtgaagggacggttgaacgcgatgttttgccgacgattggtgcagtgaccgaagctaatgctagccggtttgctttttgtacggatgataagacgattagtgacttgctcacagaagggtcgattgattataacgtgcgcctagctatgcagagcgggatgcgtcctgaactagcctacacattggctagtctcaacggcgcgatggcgcatcgtttaagtgatcggggtagtctgtcagccgggcagttggcagatttagtggtcttagatgatctcgaacacgttaggattgcgcggacgatgaagcggggacagtggatattaccaagcacgacaaaaccattgccgtttactgcaacgcgtgttcagcaccatgcacaactagccgacttccaattaccactagcgaccgggttggcaaatgtaattggtgtgcagccgaaccatatcgagacggatcacttaacactcccgattgatgcaacgcagaattttgaagcggattgccaacgtgatattctcaaaatggttgtcatcgagcgccatcataacacgggcaaggtgggcgtcggcttagttcatggcttcgcacttaaacagggagctatcgctggtacggtggcgcatgatgctcataatattgttgcggtcggaacgtcggatgctgcaattttacgggcggtagcccagattacccaagataacgggggaattgcggtcgttgacgatgaacaagtgctagcgaccatgccgcttgccattgggggcttgctgtctgcagcgagctatcaaaaagttgctgaacagttggccgaacttaaacgagcgtatgaggtcattagcgagcggccacttagctttgatccgttcattacgctatcgtttttgacattacccgtgattccaacgttgaagttaacggcacgggggttattcgattacgcgacctttgactttattccagttgcgattcaggataaccagcgtcaaacagtttaagtgcaatcgttcggtgactgaaattaggctatgatgtgtctgctactgaacaacgatgtagtttaaggtttgtgccgaaatatgtttaaagccccgcaatagctaaacgttttagttagctgctgcggggcttttactgtggttttaatgggctaaatggctgctactgtgaagcgtcattaatgcgggggtagctaatgggattgccactctcataagcgggaagatcagcgattccgcggtaaacggctcgttcaatctgctgcagcccgccgccatcagcaatcgtcattttaataccgtaatgcttgacagctttattcagtgttttggaagtggcgtgtttattctgattctgaatcatgaccacgaggtctgcttgaccgatttgccggtaatagaagttggtgctattactgtgtttaaaagcatcaatcaataaggtgtgcccgttgtgctcatcaatgagttgcgtgatctgtgttcggcgcgtaccaacgtcgcccatgacgatggcaactgttttttcgtgcagatcaaagtctaaggtgcgcagcgtcactggcacggtggttgtgtggatagtggcctttttagctggtttggctgctttattcgaggtcggttgactcgagctatgatgaacgtaacgaataaccaccttctcaggccgctccttataccaagctaggtcgactaattgaccattactgatgcgctgatactgcgcttcttgactagtgaacgtaacatcgttcattgccggattgagcgacgataaggttgtgccgttataatcttgttcgatgtgataagtatcatcggtgtcttgataatgaacaacgaaaaatgctgcgacagtaatcggatccgctgtagtagcgtgactaacgattttatcaatataaggttgtcgatgttgccgtaaattttgttctaacaggacctgatcatcgtggtgaatcaccagttgtcgggccaaaatttcatcgtagtggtagcgtggtgtgacggtcggatcattggggtcgactaaatcaaaaccctttaaatcgcgctttacttgcatgattgtttgcccattggattgtgcagaagttgttttgacggatgatgatgaatcttccgcgtttgcttgcgtagcgtggccgctggtctcattgtgtgcgttactagtggctagtctagctatgcgtgtattatccgaatctacgatggtatcaggatcaagcgccaggtttaagatttcctgaatcgctttggcacccttggcgaggccttcatcggtaggttgaatcatggtcaatgttcgggcaatggcggtacgataatcgcgatattttttcaaattaggacctccgttattatttagtaaattggtcagcgcagacatggttctgtgctgaccaaaaagatatttggtacagggtcaggtcataaccaacgatatgtatgtgttaataccacgagccaaaatgattgtgttatgctggtttaaagaaccaagtaggtcatcaattgccagtacttatcaactattgtgccatagattgtggctggacgggtataaaaaactatctgagggcgccgcttcgctctaccctcgtaatcatgatatgaaacaaccgccttctcagttataatgactgcgaaggcggtttcgtgttcatcgtgtgcttattggtgctcgctttagcccgtataaaaaaccgatggctttcagttcatgagattaatcaattgtcgtttcgtacacgtaaataaaatttcaaccctcaatgactgaaggtactgctttcaagattattaggaggtgagttttatggaagtcgttgctgaaagtgttgctggtattgatgtccatcaaaaacagattacagtttctatattggtgggcttggctaacgccaagcctaagaaaatctcgaaacgttttgaaaccattacttgtcggcttaaagattgcggtgaatggcttaagcaacgccatgttgaacaagttctaatggaaagtaccggtcagtattggcgaccggtttggcaaatcttggaacccttcggtttcaagatgatcctgtgtaacccgcgaattgttaaaaacattcctggtaaaaaaactgatcaaaaggattccgaatggctatccgaattggcgcgttacggcttagtttccgcaagttttgtcccgccaaagtcgattcaagcattacgcgaatcaactaggttacgtaagaagattacccaatctatgaccgcaaccaaaaatgaagtccataatcttttacaacgctcaaacattaaattaacgacctatatttccgatatttttaacggaactggccttaaactgctgaagttactcatagatggtgaattcatcactttacaggccatcacaaaatgtcgccacacccgcataaaggctagtgttgaacaattatttgctgcgatggatggcattctgccacgcaacgatcggagattgttgggcttgaatatggaactactcgctgattttaggcgggtattggctgaactggatgctcaaattgatgaacaaattatggaatttaatgatttgtatcttcgcctacaagacattcctggtatcagtcaacggattgctcagataatcattgccgaagttgggtcagatgtaagtccatttccagatgctcatcatttagcttcttgggccggtctctgtccggggaattatgaatctgccggtatcaaacatggtgctcatatcttacatggcaatgtttatctcaaatcagccatggtaagcgcggcgcttgccgccaaacagtccaaggaaaccggtttaaaagactacttttggcgattgcacggtcgcatgaccgcgcaaaaagcgctagtcgcactggctcataaattattacgaattatctacgtcatgattgatgaaggcaccacttatgtagactataaaaaggaccaacgcaaggcaattacgttgatcccacaaacttaaatactagctagtagctttagtatactagtttttttcaacactttcgagtgctttagattagtgcgctcaaaaattattttgtttcaaataaaaacaataaaaacgagttagtgaagtcttttcaagattagctgagctttagcgcaagtattggctgattggaacaatggtaattgttgtgaaaggtcggcttactaacacagcaatggtcaattgaattggccttacgggtgattacttataaaatgatatagcggctatcaaacgacaacgagtgcgttgacttgtttgtggattgcaatagtcgagcatcacattcaggataagtgggaatgaagttggaggcgcagcagatggcaagagttagatttgagaataaacgggtcaatatgagcaaactcagtcagtttggatttgaacccaatcagaatggtcagtatcagttccgaattttaattatgcaaggccaatttgaaatgataatcgagttgaacactgatggcagtctgaacacgacattaacggatacgacgactagtgaagtatatgttttacacctgacatcccaagcccatggtcagtttgtaggtcaagtagcgcaggcctatcaagatgttttatacaacatcgaacagcattgttacgataatgacgtcttccaatcgaccccggagcgtaagctgattgcgcaagtcagagctgtttatggtgacgatcttgagttcttgtggcctaaatttccacaaaacgcggtttggcgacgctcagacacgcacaaatggtatggcgcattattgacggtaacttccgataaactggcgttgccgggcgcaacacatgttgtgacggtattagatttgcgagcgcgcccagaagacttatctatgctgattgatggacaacattatttaccgggctatcatatgaataagaaacattggtattcaattttgcttgatgatgtggtaccacttgccacgattatggacgacgtaaaagttagttatatgttggccaagtaaggcttgaatgtaagtggacggtctcaccctaaaccgaagcattgagcattaactaaaaaaatcgttcccaagaagacatctgggaacgatttttttgattaatgattggtaaaaccatcgttagtgactattagattgaataattaacgcgaggcatggtgccgactgcggtaccaatcgaaggcgagcgttaatagcatgtaagcaaaatcaacgagaattgcttcttttagtggtacgttgagtaaaacgactgaaacgaacgttaaaacaacgacaaaagtcagtgccgattgtgcccatcgtaagagccattctggcatggttagctcacatcctttgttatgggagttgtggttgttgatgagactgatgattgtggccgatcccgtaatgcacgtagcgcccaaagaattgagaccgtatcaacaacttcttgaagcatagcgccaaagagtgccggaatgataccagtgctggcaatcaacatcaagatcgtacagatagcaatcccaatccaaacggcttgtttagccacttgcatggtatctttagcaatgcgcaccgccgtgaccacgcgactgagatcgtcttttaagatgacgacgtcggccgattcactagcagcagttgagccatgggcgcccatggcaatgccgacgtcagcaacagccaaggaaggcgcgtcattaacaccatcaccaaccatgataacggggcgttcggccgctggtacagcctttaagtgggcaatcttatctgcgggtaggaggtcggcagcaacggtatcgataccgacatcggcggcaatatgatcagcaattgcctgttggtcaccagtaagcatcatgacgttttgaacgccctcagcgtggagtgcttgaagcgtggcggctgcttcggggcggacattgtcgataaacgtgatgtaacccgcgtactggtcatcaatgccgacgtagatagcagtggtagcaagtggcttggcggttgtagtcggtgcgacgaatttaagtttgcccactttgacctgttgctgctcaatcgttgccgtgaccccattacccgttacttctgctaattgtgttgccgggctgaggctagtggcactcgcatacttgacgagtgagcgggccaggatatgacttgagttttgttcagcgctcgctgcgaggtgcaagatttgttcggcagtaaaaccaggctgaggaacaatttggttgactgttaattgaccactggtaatggtccccgtcttatcaaacgcggcggacttagccgtagataacttctccaacatgtccccagtcttgaccacgattccgtttcgactagttcggctcatccctgagacgagtgcaacgggtgcggcgagaatcagcgggcaaggtgaagccactacgaggacttctgcaaatcggtggggatcaccgctgaatgcccaagctactccggcaatgacgtatgctaccaaggtgaatgggactgcatagcgatcggccagccgtacgaatttggctggtcgtgattcggattctttaaccaatttgactaactgttggtattgactatcaatggctaatttatcaacaaccattgtaacggcactatcgccgttgaccgcaccagacataatgtcatcgccaacgtgcttgtcgactggtttagattcacccgtcaatgaagattcatcaaagagtgccgttccttgaataaggtgaccgtctactggaactagctcaccaggtttgacgactagctgatcaccaatttggacatcttcaacggcaatatctgttaattggccggcgactgagcggtgggcaatacgtggtgaattatcgagcaaggctttcaattcggtattcgctcgtttggccgcataatcttctaacgagtcacccccagtgagcataattagaacgacaaggctagcccaatattcgccgacagctagtgttgccacaatcgccgtaattgctaataaatcaaccccgtacttacctgaacgtaaggttttgatcatctcaactaacattgataaggccataagtgaccccattaatgtaatgatgatttgtgctgccaattggtagtgcaaaccaaactgtaaaataaccgcaatgataccgacgctgaccgttaaaattaatttatagtagtgccgcatgcagttcccctccttttagatgataacgtttttttacttgttacaagaataacatgaaatcggtttaattgaaacagataagaatgattctaaactaaaaactaattattacgaaaacttttaaaaagtttcaaaaaaaatatgggtgtaaaactcgtctaatccttgacgggttaggcctcgacggctcaaaatggttgattttacttctgatttaatactagtatacttataaacgaacatcagatatcagaaaatactgaaatcagcatttgtataagccaacgtgcgctgtgcaggtggtaacttgttacccggtactaagcgcttttttggtgcaccaagcaattaatctaacagttgtgcggtgggcttatctggtgattcaagggggttatctattagcaagagcagtgtaaccattaatcgttacgtggtgtgacgacggtcgtgtgctaaaggcacgatggtaatagaaacactagctaaacaagatgaacaccaacgtcgattaagcaattaaaaatcatttgtcagtatggcgttgtccggattcaaccaacggaaagaaggaaattctgctactgattttgagttagcacaaacagaatgcggatgacaatgccggtcaaacctgatacagtcagggtgctgagtgctccgaggattaactcggaggggtgtaccgattgctagtcggaaatttacgcgtggggactaccattgctggtaggaagaaccacgaatttgatctaaatatagagagtatatgctcagtagcaggtttattattttaaaaagtaagaatattgattggtgggtctatttaccaacaattgggctctttgcggcggcttccgttgttttattaatggggggccattcgctggagacgagtttaagtggcatcttgaactggctcacaaataacatgagctggctttatatgtcggtatatgtgatcacttttatctttttcatttacttagggtttagtaagttagggaaaaccaaacttggtgatcctgatgacaaaccagaattttcaacgtatcactggggcagtatggtttacgcgaccgggatcgatgccagcattttaatgttgagcatggttgacccgttacggtacctccaaagcccttcattcggcgtcaagccgttttcaacttctgcatataattatgcgcacatgctgggacaatttaattggggaccaatggcgtggatgatgtttgcgccagccacgattgcaattgcctatgcaatgtatgttaaacacatcaaggttcagcggctcagtgccgcaatttcagtactacaaggtcctggtaagggtaagcaaattgcccggaatacgattgattttctcgttattattgggattatgggtggtgttggtacttcagtcgggatggaaatccccgtcatttcaaaagttttgagtgccgttaccgggattgccgatacgatgactttaaagttagggttatttgccttattattcgtaattttcgccatggctgtttttaatggcttgaagaagggaatcggtcggctaagtgctgcccatgtttggttagcgattggcttcctaatcgttgttttaattgttggcccaactttgtatattttaaactcagaaactaatagtattggcttgtttgtcaataagtttattacgttgagcacgaatactgcaccaaatggtcacgcaacggccatgcaacggcagacgatcttctactggggctggtggttatcctttatgccagtcatgggcttattcattgcccggatttctcggggccggacgattcgtcaggtactcggtggtatgttgctatggggctcattaggttgtgtcagtttctacgccatcttgggtggttatgccttatacttgcaacggatgggcatcgttaacttagttcatatcttaaatacgcaaggacaagccgctgtgattgcagcagtattgtcgaccttaccattgaagatgattatgctggctttgtactgcctatcttgctttattttcttagcaacgacggtatcttcatttgccttcattacctcgtcatttactagtaaaaagttggccgcgggggaacaaccaagtcgtttcaatcggatgagctgggtcgttatcttcctagtcttctcattggggcttgtcacggtcggtggctttgaatcgattcagtccatctgtgcgatgtctggcttcccattaacgattgtcgcgctcgtcttactgtactcgatccatcacgacttaacgactgatccagtcaaggaagctgcgaaagccaatgccaaagcagctgaattagcacgccggaaacggctagcacgtgacgttgaaatcacaactaaaactgactacgcacgcgaacggcgtactgcacggaaacgtgaaacggaagccgattagcgctactcagttgaactaaatatatcaattaaactaggctcgtattatggatttccataatacgagccttttaagattggcccacctgtttgaaataatggtagaaagatgcctttatttaaagtcaacagccaccagcttaggcccgctggaaacagttccggttagcgtaaacctgcttagttcgttcgtcctacgccgctctccaggcatttctgccaattgctggaacgcggtggacacagatttaagccgaagaccacgtcttaaatactggtcttctactaaccaatccaaggacgattgctaagtggaatttcaccgctgagcattggccgaaacgccttccattcgggacagtattcgaatggtggacgaagatatacccaacttttgatgaatttgtcattgttctccataaacagtaattttattaatcaactgttaggtcgaaaagatattgggatagctcgctatttcggaattactatagtaataatagaacacctcaacaaagtggttagggtaaccctaacgtctcgtttaaagttccggtatcaaaatagccaacgaccaattgcaccaagttaagtggccgttcatcagccattcgggcggcttaccgaaacgtgttcggtgccactaaagtctgtgcttgctatgccaacggacaaatgtccaaaccgcattaatccgttggctagacaatgctcggcttcaacccgtggcttgagactggaggggctgggtgacaatgctcagtagccaaattattcttagtcggaagtgatttccttccggcttagaataagactcgtatttgagatgacgcgggttatgcgttagctcaaatcgatgtcggctgcgttccagcaattgtcacccagccccggaggtcggaataggacgctcaccggctgacgaacagaaaaccaaccctaaaaggcatctttctaccataattcaggtgggatggattagaatgatagcgatgatagtaaagggaggattggctatggcgattagtaatgggcatgttagttttaagcggccggcgtggttgggagattcgattacggcgaataatgggttggcgacggtgcattatcatgatattttggcggctgattgggatgtcgagcggagcgataatttgggaatctctggttcaacgattgggagtcgctacgatgcgatggcggtgcgctatcaagctattcctgaagatgctgattttattgctgtctttgggggcgtcaatgactatggtcgggatcagccgttagggcaatacggtgattgcgatatgacgacattttatggcgcgttaatgatgttactgacgggattacagacgaattggccgaccgtgccgaaattatttatttcagcaattcatattggctctgattttgggggcagttttagtgcggtgactaatggtctcgggtatcgtcagtcagattatgaagcagcgattgcccagatgactgcagactatggcgtcccacatttgagcttgtaccgtgatgcgggaatgacgtttgcgattcccgctcaagcggccatttattcggtggatactttgcatccgaacaatgccggtcatcgcgtgattgcacgcaagctgcagtcgtttttggatagccacttttaggttggcctagtcagtaatgaatggcacagttgatcgtaaataaaagcagcagcacgctaatgagcgtactgctgcttatctgaatctaggtgtcaaaacgggctacttggcttttttcttagtcttgggcccttgtttatgcttctgctcgcgcagcaagtctttgaaggtttcgatttccgtagtgtgcttagccatccattccttgtagttagaatgggagtcggtatcgctgattttaaggccggtttctaaccagaataaagcttcggttagggaaccgaaattatgaaaccagagtgtgtggccgttgtcagagtccatggcaacgtaagacttgtagtggggcgttaaaaaggtatgtttaacaattttgaatgcggcccggcgacgagttaatttgtaatccggcaagatatagcggccaggatgggccagatgtgggacagagttcttacgttgttctttatattcagtcaacatcgctttagcgcgttcgggactgatgagggtgatatcaaattttggcatagcagggctccccttggtgaatagcagtatggttaattatagtagtcaaataataatacttatactataatgatagcgcaattttatgaaaattcgaaatataaaaacctgaaaattagggattttccctttcttacagtaaatttaagtaaaactaatcggaggtttgattatgagtacagcacccctcagttcatttgaaaaaaatattccggcggtaaccgaattgttagcggttgatgctgaattgcaaacgttctttgtggctttgacacctggttatcagcgcgaatgggcccgctttatttttggaactaaggcacaagcaactaaggaacggcacattgaagttatgaagacggtttttcgagctggctataaatctaagcgagcgtatgatagtcggccggataaataggtggattttggcaatttgaaatacggtgacggattgcgattaagaattggggtgtagccaccaagatctaagcgggtctgggtcctgatttggtctaattgctgtcaattctgtggctagcaggccttgtgagtgcctctaaagcctgcaattctgcttcccgagcattaagcgtggcctcaattgctacgctgagcgtgcgcttcaaccggcttaaacggggaatgtctagactgacatcatcaccataaattgtttccagcggtgtccaccagacgggaccggggttgggcgtatcaccgttatggcgaggaaataagtgccaatgaacatgcgcgtcaccattcccgagtagttcaatgttcattttgtctgcatgaaaggcctgcgcacaagcttcctggacgatactcatctcttcaaggtatcgtaacttctcgtgtgccggtaaatgatgtaattcggtaacgtgatgtttggctaaaaagagcgtgtagccttcaaagtactggctatcagcaaggaccacgtagcccgttgtgagttcgtaaacgaaataaggattctgatgtgcctgaattagtttgattcgttcacagatcgtgcaagtggatgtcattcgctcgcctcctgagtcttgataagattaagtatacgcgtagatgtggtgagtacatcaaaaatgttagtgaaacgtctaaaaaacgacgacctgaaaatcaatcctgatttggggtcgtcgttttgattgtaaaaactaatcgtcaattctgttaggtcgatcgtgattaaggtaaatcgttgccagctgcaaagtaaatgtcgtaccattcttgccgagaaagcgtaacgtctgctccagcagcattttgagctagatgttccggattcatcgtaccaaggacgacttggaagtgggctgggtgccggagaatccatgcggtcgcaatagctgatttagtgacctgtttctcatcggcgagtgcttgcatggcattattaagttctggaaacttcggattgtctaagaagatacccgcgaagttaccgtattgataaggcgaccaagcttgaatcgtcatcttatggagccgtgagtattcgatcatctcgccgtcgtggttaagactacgttcgtcctgcatgttcgtgtgcaagccaaagtcgatcgcaccggtatgcatgataccaaattggagttggttgatgatgagccgttggtttagtgccgcttgaagcatgtcaacttgcatgggattgaagttagagacgccaaagtggcgcaccttgccgctagtttgcaacttgtcaaaagcggcagcaacttcttcgggttccatcagggcgtccggtcgatggaggaggaaggtgtcgagataatcaacacctaagcgttgaagctcgccatccacggctgccagtatgtgctgtttggaaaagtcgtaacgcttgccaggaacaatgccgccttttgactgaatatagagctgatcacgcgatacgtgagcctgcttgagtgcttgaccgaagatggtcgatgattgaccaccaccgtagatatcagctgaatcaacgtaattgatgcctaaatcagcagcggtatcgataaccttggtggcttgagcgacatccaaggcgtccatgcgcatgatgccaagcgccacgctggaagcttgaatattgctgtgacctaaattaatcgttttcaaaactaaagtcctcctcaatgtgcaacttgatttaaattcagtatacggttttcgtaagaggatgtaaacggttacgtctggtgccgactgttggtaaatctgattttagagcaaaaaaaatagaacccaaggcttctctacttgagttctacttatgaggaataatcctgattagcaatgaaaaattgttcagtgttaatatgatacaccttcatgctattcaattttacgcgtgtccaacttctaacggactaacccgtatttattgtaactatctgctatagtcgatctaaagtaaggttgttacttgattgcgactcgttagacgggttttaacgaaagtcaaactcgcgtttaaaacttgggaatgtcttcgtaacagacatgcacctccgtttaaactttgtaatacctgagtctacaaatggaactggtaatgtggaactaacaactggtcatcggagacacctgtttccaactaaaacttagttaaaatctgttcgtcatactaatgccaattaattctttgcggttatcgtttatctaagggtcaacgttcagtcatccaacgtaaatctcacgacactcgctagaccgataacgcttcacggcgcttaaaacggtttcgataacgacccaaactgtgatactagctgtctaacattacagcgacagccaaactcttttgagaagctttgctaatcgaggattaattcctttcctcacttagtataatagcataaaccgcaaacgcttacaacaaaaacaaccgcgaattcgcaataaaaatcaatagtgactcaaaacgctgctatatcggggattatagtaatttttttcgagaaatagtcgcataatttgctgattgaccgatcgtttgaaaagtcggctaattagcgctaataattgattgaatatgggctgacatacggtacaatagaagtagacaagaaagcgctttatataacgatgacgtgtatcaagtgtggtggcacttataccgcgaaacgttggcgtgattaatcagtgaattcaagctggtatggaaggacgagatacgatgacaacaacgtttaaagaccgggccttcgaggcgctaggacatgtcattgaccctgaattaggaattgatctagttaacttggggttgatctatgatgcacaattgacggcggaggggaccgctgaaattaccatgacgttgaccattgcgggctgtcctttgaccgaatggttggctaaggacattcacgatgaactgatcaaattaccagaagttaacaatatcgagattgagattgtgtgggaacctgcttggaacgaaagtatgatgtcccgcgaagctcgaatggaactaggcattcatagttagtggccggcctgttcgcagctagttcaagggctgacggtcattggatagggcatgattaaggaaagacgttgctggtttaggcttgcggcgccttttttgcgtgccactgtactaattccagccagcaatacgtgcatgcgtcgagccagcaaaaaaacaccagtgacacaaccatccgtagacgattgtatcgctggtgttttagtcatgctagaaatgccgatttaaagttttggcaatggcatccatgtcttgtacccgttgtaatcagcggtgtgcagtagtttttcggcatttgccacccgatcttgggttggagactcgattccttcaagccggtacttgatcttcatttcatgatattttttaacgcccaaagtatggtacggcaatacttcgactttttgaacgacgtcgtttggaatcttagcaatgtaatcgccgagtttcttcaagtcttcatcgtaatcagtccgttggggaaccaggacgtgacgaatccacatatcatcgtggtgttgggccatgtactgaatcatatccaagatattttcgttcccatactgggtcaactgcttgtgtttggcagaatcgatgtgtttaatgtcgaccaacgaaatgtccgtgaccttcattagacgttcgaacttgtcaaagaaaggttgttctcgggtaaaaggctgtccagaggtatccagacaagtactgatattcatcgccttggctttttcgaataagtctaagatgaagtcgatttgtaccagtgattcaccaccactgactgtgatgccacccgtcttgccccagaaagcccggtatttagccgcgtcttcgagaatctcgtcggccgtcatttgatcgccaacgttgagtttccaagtatcagggttgtgacagtattggcaacgcatgtggcatccttgaaggaatgccacgtaacggatacctggtccgtcaacggagccaaacgtttcgatggagtgaacgtagcctatcaaaggctcctttgccgccgcttgcgttgttgaaacttgtttgttttccatgagcctttcgccttcttaactattaaagattaaatgttacattgattcgaagaatgtccgtgaaataacgtcatcttgttgttccttggttaaatctgcgaagtagacacagtagccagaaacccgaaccgttaatgttgggtattcttcagggtgtttctgagcatcaatcaaagtgtctttattgaagacgttgatgttcaagtgcatcccatcgttcttcatgtaaccgtctaacatgtttactaacgtgtctttccgtgattcgaggtcatggcctaacgtgttaggagtaacgccgaacgtgttggaaatcccgtcagttgcgtaacggtatggtaatttggcagttgaaagaagtgaagctaatgcaccactcttttcagcaccgtatgcagggttagcacctggtgagaatggttcgcctttttgacggccatttggtgtggtaccagtgttcttaccataaacaacgttggaggtaatcgtcaaaacagaagttgaaagtttggcattccgatagaggtgatgcgtgttcatcttgctgtataattctttgactaaccatttagcaatgtcatcagcgcgatcgtcattgttcccataacgtgggtagtcattgtcggctttgaagtcaacggcgataccacgttcgtcacgaattactttaacgtgaccatacttgatagctgagattgaatccgcggcatgtgataagccagaaatcccagttgcaaaggtccgatcaagatcagtattcttcaaagctaattgggcagcttcatagtagtacttatcatgcatataatgaattgcattcagtgagttaacgtaagtgtcagctaaccaatccatttgcttgtctaatttcttcatgaattcgtcgtaatcgatgtattctgaagtaattggttcgtaagcagggccaacttgatctccagcaatttcgtcgcggccaccattgatggcataaagaatcgctttggctaagtttgcccgggcaccgaagtactggattccatcagcaattggttgtgcggaaacacagcaagcaatgccataataatcggtaccccattgtacccgcatcaagtcatcattttcatactgaatggttgaactgtcgattgaaacttcagttgcgtaacgtttgaagtcttctggtaagcggtctgaccataaaatcgtgatgtttggttctggtgcggcgcccatgttgtccaaagtctttaaaatccggaaagcagtcttagtcacatggtgttgaccgtcgacgcctaaaccacacattgataaggttgcccagattgggtcaccagagaagagagaattgtattcttcagtacggatgaaccgaaccatccgtagtttcatgacgaattgatcaattaattcttgagcttggctttcgtccagaacaccattgtccaagtcacgttggatgaagatgtccatcgttgtatcaatccggccaacggacattgcagcgccgttttgggtcttgatagcagctaagtaagcgaagtacatccattgaatagcttcttgagcattagttgcaggcttgctaatatcgtagccataactggcagccatcttcttcatatctgctaaagcacggtattgatcttgaacttcttcacggaggcgaataacatcatcagtcaattcaccatcaccaatgtgggcaaagtcattagctttgtcttccattaaacgatcgatcccataaacagcgacccgtggaagatcaggaatgagacggccacgtgcgtatgcatctggtagtccggtgatgatcttgtagtgacgtgctttccgcatgtcaggagtataaacatcgaagacgccttggttatgagtcttgcgatattcagtgaaaatcttgtcgttttcttcatcaggggtataaccgtatgatttcaaagcgtcatcagccattcgaataccaccaaatggcatgaaggcccgcttcaaaggcttgtcagtctggagaccaacaatcttttcgagatctttttgaatataaccagggccgtgtgaagtaatcgttgcaacgactttagtatcagcatccaacacaccaccagcggcacgttcttgtttctttaattctaagactttgtcattcaaggtcttagtagcggctgttggtccggccaggaagctttcgtcgccattgtactgtgtgaagttattttgaataaaatcacgaatgttgatttcttcctgccagtgcccgcctttgaaacctttccaagctgctggttttgttgtcttttctgatgtaatcattttctcgcctccataatttgaatccaatcaaatgattgataaaattctatatttgaatcataacattttttactgaatttgtaaccgctttcaggtgatttatttcacgtttgggttatttttttgcaatctattattgaaaagttgactattaacgttgatataacagtacttacatagctagataggcattggtaattcacttaattatatttagaaaacggctaaaaacaagacttgttttgatatataagtggaatattgtccataatgtaacaagtgtttaactagttaattaataaaaagtgcaacgaggtgtggagggtgttaaaagcgtttgccgttgattttatgaggaagttcgttatcataaagaagataagcagaaactagtgaatgtagtgaaaggtgggcgtaatgcggatgctcgaaaaaattgaacaatatattgacagttgtattgaagctggcgacatttatggggcgtcgtttagcttgatcacccctaaaggtatcaatcaatactatcatggtaagcagggccgcgatgagtttgccgtgggcttagatcctgcgatgatttatgacctagcatcggtaactaaggttgtagggaccacgacgaggatttttcagttgttatcggaccacacgattcatttaacggactcggttgcccggtttttacctgggttcactcatcctgaaataacgattaaaaacttgttacttcataatagtgggctaccggcagatattgataacctggataagatgcaacgtgaagatctgatcaaagcggtttatgatgcgccactcgtcacggcaccagggacaacgtatgtctattcagacctgggatttattttattgggatggattattcgtgcggttgacggctcattggctcggagtattcaagaccacgtttgctatccactagcgatgaccaatacgggttataacttaaatcgtccgaagattcggtttgtgccgacggagtttgatccgcggcggggtcagattcaaggacaggtgcatgattataaagcctttttgttgaatggtgagagtggtcacgcaggcttgttctcaacgctgacggatttatccgtatttattgaaatgatgttaaactttggtgaatatcaaggcaaacgggtgctggatgaaaatgtctttgactggttaggcgagtatgacgaaaatggccggacgttaggttgggaacgacgtgcgggacgacatcaatatttccatactggttttactggcccggcagttgcttttgatttggatcgtcaaattgggctggttgtgttaacaaatcgagtttatccaactagtgacaatcaggtctggaaccaagatcgtaagcgagtattcgatctgttttttgaatcctgatgatggcagcttcattaatagttagtagttaaattaaataagcgtcgcagccacttaaggctgcgacgcttatttaattacgatttcatgacagctagaccgctgaagtgtttggcacttgtgggtgctaagcaaacgctattttgctttttgcttctatatatacgttatttttgcaaccagcgaagtccgggaacatgacgtgcaattttataaccagcggcaccgataatgacaccagcccaatttgtgatgacatcatcgatatcaacccaacgtttgaggttaaccaaccagtcaaggatgaattgtcccagctcgagtgttagccccgtaagaaatcccaaccaaataaaacgacgccaaggcaagtcgggaaaattccatgccagtaaaccgcccaatggaacagtgaggagaacgttgagccaaaattcaatgtcaagttgttggaaaggaatcacgttcagcttaacgggtccccattgaatatattgaataacgagttgggtaccaaaattgtaactggtaggtgtatagcaaaaagcagttaagacccagagaaaggcaattaaactgagttgcttaaaacgctggatatttgtgcgcgctgatcgcgtacaagcgtatagtagaacaataaacattaatgaaatcaaaaagaatggtagccaagctagcataatttagtcgctcctttaattaaatagtatagagaaagaaagctggtttgactattaataaaaagaaattcagaaaaagtgttgacactttttacttcaattggtatattagtaaacgttgctgctacggcagatgcatctcaccaccaaataattattgaaattagttgttgacaatttcttcagtaattggtaagatagtttctgttgtcgtaacggcaactatgacaaattaatcaagttacttcttaaaaaaagttgttgacaagatattgattaagatgttatgatgattaagttgtgttaagcgattaacacacggaattagatctttgaaaactgaacaaagtttcgacgaatcaaatgtgtagggtctcttgattttgaatcaagagcaaaacatttgcgaagtcaattcgctagcaaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaatattacggaaacctacacacgcgtcgaaactttgtttagttttgagagatttaactctcaaaacttgttctttgaaaactagataatatcaaatatattttttcataatgaaaccgagaacaccgcgttttttgagttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtctggtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattagctagttttgagagcacaagtttctcaatagtgtggtgacgatggcgagaaggatacacctgttcccatgtcgaacacagaagttaagcttcttagcgccgagagtagttgggggatcgctccctgcgagggtaggacgttgccatgcaacctaaggaatcgttaattcgattcctttttttgttgccaaaaattagcctactgggcgaactaagactaaattttgaaattcaaacggcgggtcggattattaggaatcccggtactcatcagcgcatttggaattcaacccatactattaatcaccggcacgatctacttattggttgcaatcacactcattgtactgaataagtttccgttgagttgaatcgttagcgattgcgctcaatgctcatatttggggtagctggcagtgatgggggagttgtcaaaacgagagacagtagcactcggattttgagagtcaggcgtaaatggcgtacgtttggttggttagaaaaatcgatgctagtttcaagcgataaagtgattcagctcagtctaaggtactaggtattggtttacgaacttggccattactaaccgctaatacgggctcgtgggcctaatgtcatttaatttggacagtatccgtcataaccatgtaaaaatcatgtaaattcgggagcaataattgttattctagcagttacgtgctatgttattatcatattttatgaagtggagtgatagttatggctcagatttctgtgggggatcgggttaaatgtcaaaagaacggcaataccgattatgatttttatgctaaagttgaaaaaatttacgagaactccgccttcgtcacaattactcattatgatttgcgggatgatattaatgtggcagaacttcaatatcgggcagtgatcgccttaaagaagatgaaacccgctaaaccgactgctggtgaagcgaagcagctacaggcagttagtacggccatgttagctgaataaattaagaatatcgatgcaacatgtaggtaatgggttgttcaagaatttgattcttgaacaacccatttttagtttggctgcaaagcttttcggtgtgatggagtgccctgtttgggactgattttatgatgattagaggccaactgacttaatgaatctgtccgttagagctttaacagattggatatttaacaatcattcacgcgggtgttgttacaagctaattgtgcacgcctctttattcggtgcagcaaacttttttgttgccaatctgacttttagcctgtacatcattggtttcaatggtacaatggatattagtagttgataactgttctaaagtaaggaggggttttgaatgcagacagctaatcaaaatgtaacgttgacggggcgtcgacgcttctggttcatttttacgctgttgcttgggacttggaccatgtcgatcagtcagtcttccttgtcgacggtctacccaacatttatgcgcgactttggcatctcggcctcaaccgtgcaatggttaacgaccggctttatgttgacaatggtcgtcatgatgccaatcagtccgtggttgttgaataatattgggtttaagaaattattcttagccgttttggtgcttttcgatattggttcaatcattatttatttcgcacccagttttggtgtgatgatggtcggtcgcctaattaaagcggcggcagttggcgtgctgtttccctcgtatcaatccattttactgacgattacgcccgaggaaaaacggggtagtacgatgggtgtcgccgggttggtcatgggatcagcattagcatctggcccgattatttccggtgtggttttgaagtttaccgattggcacggattgtttgccgtcttcatcacggtggcaactttgttgatcctaattagtttcacaacgatcaaggacgtgatggtcaataagccttcaaagctggatttgctctcaatcgtgacgttactgggctttgctgggattttatacgtcgtgaatgagattggtaaacccaatgtgaactggacgttcggttggctgttattagcggtttcagtactagcggtggcttactttacttatcgccaatttcacttggagacgccgttattggaactacgggtcttaaaaacatttaattatgacttagccattttcttaacagcaatctcgtacgtggcgctgattgtcgtaacaatcatcttcccactctattaccagggtgtcttgaaggtgtcgccattcgtttcaggcatgtcactggtgcctggtgcggtgcttctaagtattttgaacccgcttactgggaaactagcagagaagattggatacaaacaaatcatgttacttggtatgagtatgatcgttgttggttggctgatcttagcactgatcaattcagagttgaacctgctcaccatgattttgctggctgccttaattgaaggcgggaatgcctttgtcatgatgcccgccgtcacattgggggctaattcattacccgatgaactgatttcacacggtaccgctgtgattacgacggttcgtcaaattctcggttcagctggtgtggccgtggcgaccttggtcttatccaacgtgacgcttgctcagaaacaagcgggagcctcaacgttgcgtgcgaacttgcaagggtaccatacggtcttctggatgatgctcggcattgaattggttggcctcgtgcttgcgttacttttgcgtgatgggcgcaagcagtcgcattaataatcacggtgactgactaccaggcgagaatgactgaagttaagtgggatatgctttgaacgccactaattagacattagtgcctgcacaatcggtcggttagtcgtaattaggccaaaagggccgccattcttgtaatcaagaatggcggcccttttttcgtggcgcgactgtgatcgtactgaatcacaggacttggcccaactaaccggggcgcttctacttggctgttgctttttgaatctttgccaattgacgatattgactgagcatccagctttgatacgtctgattggccggtaacgtttcggtgaccttcagtactggcacatcgtatttcctggcgagtttgaccatgttcgtgaccaagttactatcggtctgagtgttttcaacgaaaaaggcaatccggtggtgcttgatgtcttgttgcatttgctggatatccttaggtgatgggtcggaaccctcttcaattgcatgtgcgaaatgcgtattgctgattcggtagccgattgccttcaatgagtagtcaaagaccggctcactgacagcgacacgctgattatttgcatgctgtttcaattgtttgatcatagtggttatagtcttagcgttggtctgatacttttgggcctgctgttcaaaataatgcttgtgctgcggctgaattttgctgagttctgttgcgattttagttgccaatttgggcatcgttgtgggatcgtaccagacgtgttcgttggccccgtcagttttatgagccacgtcggttcccactgtgattacccgggcgcccttggctttgttgacagtaagcttttccatccagtcatcgtagccgaggccgttgtaaatgattaattgggcgctactagcctgcttagccgtgttgacggtcggctcgtagtcgtgggggtcaacgctcggtcgatcaataatcgaggtcacttgaccatactttcctgccaccgccttagccgtttgaccataaaagtcgagactagccatgatattaattttgtcgttagtcgttttactgggggtgctcgaactttgacagcctgctaatagcccgctgagtcccagtattattgccaaataaagccatatccgtcggttgaccatgtattgtaaccccattctctttaaatcgtaaccattactgttaactttaccgaaagaaacggtcgtcgtcaagtctttaagataaggtttagactaggtgaaaacactgcactgactgacgaaagctggtaaaataggcgtacctgaaaagcggaaggcggggcacgcagatgatatttacgattgtgattttaattttactagcaagcgcaatttttcgcgggtttcaccgcggatttgtgattgaaatgttgcatctgattgggacggtcgtcgtcctattgtttgcacgactactctatcagccgttagggacaatgattagtaatctattgacgaatttacatttaattgaagcttcagtggcggcaacgttgatcattaacctggtcgctttcttcgtgttaatttcgttagggtggtcagtgattcggttgttaggccgtgtttcacgtagcattacgtggctaccagttattaagcaagtgaacagtgttgcgggtggaatcgtgtcatttgtcgtgacgtatctggttatttttgtcgcgttgtcgttggcgaacatcgtcaatacgagctttattcagacgcaaatgacgcagtcaccgctcgccacctatattgtgaagcagacacctggtctaactagccattacctcagtaatttgattaattttaatgatgggacgactacggattcctagagttcatggtgggggtacgactgctttaaactaagacaaaggcgttactggttttttgaccagcaacgtcttttttgatgaaccggtttgttagcaacgcacttttttcggttcccgaacgattgctagtttttatggggttatttggctgattactatcatattgagcgtccttcatgctatgattataagtaaaaatgagcaagaaagaggctgggatacttatgggcatgattcgaattaataatttacgctttcacacgtttaacggggtacttccggaagaacggcgtaatggtcaacaactagggctagatattgccattaaatatcctatcgaaaccaaggttcaacacgatgacgttcacgagaccatcaattacgcggcggtccgtaacgtggtcgatgaatttgtaacgacccattcatacaagttgattgaatcgctagctaaccacttattgcagacgttattgacaagttttcccgcggcggatgcaatcaatattaaaattcgtaaatatagcgtaccaatgcctggaatctttgatgatgtggaaattgaggtggaggggacgccgaatggcaagtagggaagaacgggtttatttgagtgttggttccaatattcatccgcgcgtccaaaatattcagcaagcccttagccgattacgagccgtcaatggggtaaacgtgattgacgaatctcattggtatgagactcaaccgtggggaaagcgtgatcaggccaatttttacaatgtttcggtatccttaacgactaatttgacaccagaagaactattggatgaattacatacaattgagcaggcgggccaccgccaacgcttggttcactggggaccacgtacgattgatttggatattattttttggggcgaccggcaaatcaacacagcgacgctgacgattccgcatgcgcaggcagctaagcgcaactttgtgctactgccaactgctgaaatcgccaaaactgatgtgttagttggaccacaagtggcccaattgattgcggctaatcaggatcagagttggattaaaaaagtaagaaatgtgagtgagttagatgattgatgagaaaaaccaagcaaagattgagcatgcagtacgagaaattttaagtgcagttggtgaagatcctgaccgaccgggattagtagaaacaccagcacgggttgcacgaatgtatgcggaagttttcgctactaagaccgccgcaccatttgataattataaactgttcaaggttgagcatccgactgaaatggtattacttaaggatattccattctattcgatgtgtgagcatcaccttttgccgttttttggcacggttcaagttgcttatgtgccgcagcatgaacaagtgattggcttgagtaagattcctcgcttgattgactattgcagtcaacagccgaacgttcaggagcggttgacagtttccattgcaacagaattacaacgaattcttgacccggctgggatcgcggtctcaatcacggcgcggcacatgtgcatggagatgcggggtgttagcaaaccgggtgtgcatacggaaagtagctattacagtggtcaattcaagacggatttagacttgaaacgagaattcttacagcgaatcgcaaagtaggtgattgagtggatacagggacgattgaacaacattatcaggacttattagcccaactaaatcaagccatgttagccaataatcatcagcgtgttccgttattacggcgaatcatggcacatcttggccaccctgaccattattaccatgtgatccatatcgctgggactaatggcaaaggctctacgggagctatgttagccagtatcctgcgggcgcaagggtatcaagttggccgcttcagcagccccgcgattaatgatgcgcgtgaacaactgcaatgcaatgggacgtggatcagtccagcggaatttatcgatacgtatcgtgagattctaccggttctgcaaaatatgggactgacagctagcgatgtctccatctttgaatggttctttctcattagtgtcgtttggtttcggaatcaaaacgtgcaatgggcggtcattgaagccggtttgggcggcttgtatgatgcgactaacgccttagccagtccccaactcacggtatttactaagattgccctcgatcataccgccattcttgggcccacgattaccgcgattgcgcaaaataagtcaaaaatcatcaagccccatacaacagcagtgacattggctgaccaacacccagaagccctggctgttttgcagaccgaagcgctcaatcaaggtgttcggctagtgaccgctaagcacgcgcaactgacggtgactgggcaaacactcacgcaaaccgtcgttgatgcgcacagtcagctttttgattggacgcaattaacggtcggactgagtggcacctatcagctacaaaatctgcggttggttttaactgtggttgcagtactacaacagcaacaagttaacttgacgaacagtgcggttcgccgaggcttgcaacaagtttccttgccaggccggttgaccgtgttacaggagcaacctgtcattattgccgatggggcgcataatccggatggcatggcagcactagtggcaagtgtgaagcaattactcgctggtcgtaaattgatttggatcgtcggggtcttacaagataaggcctaccctaaaatgctggctgaactattaccggtagctgacgtcctgattacgaatacgcccgcaaatccagaacgagcgttatccgcgactaagctggccgacacggcgaccgcattattaacgcccacctttatgaccacggctgcgatgcaacgacagccagacttattgactgcaacgacgatcacggatgcgttaacgcaagctcagcagcaagcaaccagtaatagtgcgattattgtaacggggtcattttatgtcattcgtgagctccaacaggctggttggccggggttaagccaatgaagacttggttgatcgcatccaacaacgctggtaaaagtcgcgacttgatcgcgtgtttggcttattatggcttgactgctcgtcagtacttgacagtggcgccgcggctcgaatttcccgtggaaacgacgacgagctatgtcgataacgcggttgctaaagctcgttttggggcgcaacagctaggggttccggttatcgcagatgatagtggcttagagatttccgcgttaccaaacttgttaggtgtgaccacggcgcgcgacttaggggttgcagtcagcggctttgatcgcaatcaggaaattttaacggccctacgcgatattcctgacaacgagcggcaagcggtgatgcgtgctacgttagcggctgcctggccagatgggcggaccttggccgtacaagcttcgatcaccggctacattgcgtcctatcaatttggacgctattctgggggatttgaccgaattttctggctaccgcgctatggtcgaactttggccgaattaccagcaacgtggcgcatcccgctgacacaccggggacgggccgccttaaaattaatcacaaaactttaaaaattggaaggatcggtggagtatatgttagtacaagatatcaccagttcattagcacaagcaacggattttgcgagtcaggcgttgaatgcccaagttcaacgacaacaacaattagttttgcgttttagtgattataatcgggaacagcagctccgattaacccaactatgtcagcaattagatggggtcgtgctggcgagtcctgaacagttgaccgtcttgttgaaccagacagctggtcgccagttaacccaccaatggtcgcgagtctttacggatcaagcaacgactcaaattcaattgacccaaattatgaaacaatatgatgttttttggcaagcgggtgagcaccggtttaatctcaccaagaagccgatgatttatggcatcatgaatattacgccggattcctttttcgacggtggccagtacaagactaaagatgacgtactgaatcacgtggatgccatgttacaagcaggagctgacgtaatcgaagttaatggtcaaacgacacggccgggcttcacggaagtcacgccgcaagttgaattagaccggacgttgccgtacattcgcgccatcaaggctcgtttcccggaagcagtcttagcggtcgatacttataagtatgatgtcatgcaagccgtcctggaagaaggtgtcagcattattaacgatgtgaacgcctttacggacgaccctcgcaagctcaaattgatggctgacagtcgcgtcggcttactaacgatgcacagtagtcgtgaccaagaatataccgatctgacgagcagtatgcgtaggttctttgaacaaaatctggcagcattgacgagtcatggcatcgatattgaacgaattgctttagatcagggaatcggctattcacaagtcgcacatggggaacaggattacgtgatgatgcgtaacattgatgaatttaattacttgcgacgcccaatgatggtggctatttcacggaaaggttatttaggtctattgcttggcctgaagaaggaagaccggttaccaatgacgttggtcactgaagcagcgatgatgcttaagggtggccggatcatccgggtccacgatgtggctgaaaccaagcaattgattacgctgttaggccgaattgagaatggctattggttatcgaataatgattagtccggatgattttgacgatattacggcgaatggggttaaggactacgatgcttacttcggtactcccacgtacgatgatcacgttttatttgaattgttagtggttggaatcttacaagtgggtttaggctggcgggtcgcggctagtcagttaccagtattgcggcaacatatggcggggctgcgggtagacgccgtagccgccctggacgaaccggattttgaacggctgatgttgactcccaaagtgatgcacaatggtcgtaagttacgtgcaatcattcaggatgcgcgtgctattcaacaattacaggccgagtatggtagctttagcaactacctgtgggtgtttgtcgatgcgacaccaatcattatgccggcacccgatgatgaattaccgacgcgctcacccctgggcgcccgcgttgcgaaggatttacaccgacatggtttgaccttcgttggaccagtcgtcacccacatgtttttgttggcggcgggattgattaaattgaattaggtagaattaggctggcggatgctggccttttttatttgcttatgcctgcgtatctttgtgagtatcaatgtgtgaatgtaagcaaggtgggggctttaatccggagtggttatgggaagtgtgattattagttccatcgcaatatgaagcgcaagttcacaatgagggtaagcggcaaaaacatatttgaatggtcggtgatgctggcgtgtagaaccagtctaaccgttttctaggtaatagtgaagttagcaaaaacacgtcgcaagagcaagttgtaatggtcttatgacgtgttttagaatgagttgattttgtatcccgctgacacgactagcggttagcggtcgtcgtcgtgtctggcaacagccacatcgttaccaagccaatcagccaggccactaagaagaacgccatggcagctggtaattgatagccaagcaaccattggcataacaagataagcgtgataatgataccgataacgcgattgatgatgctcatgtaagtgcctcctaggtggttagctaagaatgaagtgaaccagattatctgaattaataaatattacttaaattatataatgaatgacgttatgtgtgctgcaatgtgcgttaatgtcttaatttaacgtacgaacgtcgaaaaatgctgaatatttgaaaaaacgataccgctgaggttgcggtatcgttgaacctgtgactggtaattagcatcgtagtgtgactaactcggatactggttagtgataactacttctagtaccataacgtttcagcaaacggtatagcgtttggcgcatagattttgaatgaataagcgttatccacaaaaatcatgctcactgcatcagactgatggttatactgtgctaaatgcccagcatgagcgggttaattgcatgtctggaaaatacagactagtttttttacttaagaaggttgtatttatctgataagacacctattataaattgcaaatataagtaagacatttaggagtgattggttatgattaatcttgttttctacaaatactacagattctgggctgcaatcgttttactattgctaagcgctaacgtttatccagcaattgttaacggtaatgtcttaggtcgcgaattttggcgaaatggcacaaatctgattaatcttgtttttgtaattgttgctattggctttttaattcaagtgttgttttttaagaaaggtgagccgcgtgcgaatgaacgtgcattttgatcaggtcatggtaaaaaagcatgatttttaatcgcgttatggcaaccaaagtatgagggagtagtcgaaagtctgatatgaaattctctgaaaaactaaaagtgtgtaggaagcacgcacaattgacacaatcgcaagtggccgaacaattacatgtatcgcgcaaaacaatctcaggctgggaaaatgaccacagttttcccgatgttggcagtttagttcaattgagtgatatttatgacgttcggctagacgatttaatgcgggatgatcacttactggcttattataaggaagcagaacgacttcatcagaagagccgaaaatgggtggtcgtctcgtatcgatgcaatttcttgttactggtacttggctacattgactatttgcggccgtttggaatacgaacgtttttggtaccgtttttagtactggtgaacgccatggtattattgtcgtatttttcagattggcagcggttcaagtcaggtaaattgcgtgtcggtatcgtcatcacggtgtttattgcatttattgctgagattctgatcaatacaatagtaccgagttatctgaacgagttagcacatgccgttgatgatggccccgctgcgataattggtgaagtggccggtcgcttgctggtcacatcaatactgatattaagtttggtattagctatctttttgaagccaaaacaacgagaacggtcgtagtttaccgagctagtcaatattgatgagtttggaagtgagccgtggcgtctcaaactaacgaaaatgtgtaagacaaaaaacgaccgcatgcttaatagcatgcggtcgtttaaggcggaagagatagtttatacagaaacagattcgatttggatgctgtgtatcataacttaactcacgatgaactaaatcgaactatccgttgtttcataatccaccttgccaagttcaatctgaatcgtgatatgagttagtggaaactgggcgcttaggtccttgttcagttgttccaaaaaggcattattgtcagctaatgttgaacgacagagatggacggtcatggctgtttcagtagtactcatgccccaaatgtgtaaatcgtgaatctggttgacggtgggctggatggttaaataatcagcgattgcttggcggtcaacattgtttggtacagcttctagtgaataattcatcgcatctcgtaagagtccccaagtaccaatcaaaatcacgacggcaattagcatggaaacaacggggtctagccagaaccagccagtcttcaagatgatgaagccagcaatgaccacgccgatggagacgccggcgtcggcggccatgtggagaaaagcgcccttaatattgagatcgtgcttttggcccttcataaagagtaatgcggtaaagccattaatgacgaccccaacagcagcaacgataatgacatcccattcggcgacgggacccggattactaaggcgctggatggcctcgactgaaatggccccgatagcgactagtaaaaagacggcgttgaagagggcggccaagattgatgagcttttgtacccatatgtgtacttatcgttggcgcttttttgtccaagccagattgccagccaggagatcagtaagcccaggacgtcgctgagattgtgtcctgcatcggcaactagggccagtgagccgctcgcaaaaccgtagccagcttccaagacaatgaaggcagtatttagggcgaccccaatcttgaaggcgctggtctgttgttgtatttgatggctgtgtgccatatgaatcacctacttcttagttgaatttatccttgttatggctataatttaaatatgaatgaacaaacatatgaatggatgttcatgtgtattgtaacacgcttacatgacaatctcaattagaaattggagtttatgatggaaaatgaaatggaccatgaaatgatcgtcaaacggttggctgaactgatgccgccgactgatgagttgagtcggatcaccgcaatctttaaggcacttggtgatccgacgcgtgcccggattatctacgcgttggccgtatctaagctgagtgtgggtgaactggcgacgggattagccctgacacagtcgaatgtgtctcatcagttaacggtcctcaaacaattaaaattagttgtgggaacgcgcaatgggcgtaacgtgcactaccagctggccgataaacatatcattagtatttttcagcaggtcgcagctcacgctgaagaagccgataattaggttgaataggtgtaaccactgatcagttatgatgagtggtaagcgctgtgggttcgtagtgggcactgatatagatatccatggcctagaggaccgcacgattagcttgaatataagattgtgcttagcatgacaccgcgaaatggttaatttcgcagtgtcattttttgaactagttatgtttttgttaattacctagttttataaactagatgtattgatatttacactatgtgatggtatgctggtgtcaataataaatatgaggtgattaacatggcacagtcggcgcgacagtatcaaataacaaatgaagtcctcaactcagtgactcatgggattgggattattttaagtatcgttgcatttgtttttttgatgctcaaggcatatgcggatggtcagcccctcgaatgggcggcgtttattatatatggttgttcgttgtttgtactatatacgtgttcgacgttatttcacggattatactttacgcgcgcccgcgaagtttttcgtatcttcgatcacagtggcgtgtacgtgctgattgctgggacatacacgccgtacagtctactggcgattaagggttggttgggctggacgatcttattaacgatttggattttagcgattgctgggattacggttaatgctgtttggcctggacgtttgaaaaaggtcgaaacggtcatttatgtgttgatggggtggatgtgcctcgccggtggtcggcagttatgggaccatttaggtgtcactggcttctggttattagttgccgggggcgttgcgtttaccttaggtgcattactatatagtttcccacggattaaatatttacacgttatttggcacctattcgtgatggtgggaaccacgttgatgtttttctcaatttatttctatatttaaggatgactgtggggaccagctgctgagttggtcctttttttttagatgcgggagatttgagtcgcggatgacgtcttaaatgctgattattgacattttattgcgaaaagtttttcaactggacggtattcgaatcgtaaccattgcgtacgctcgttaagctgaatgagttatcgccactcagctaacaataattttgaaattaaatggctagatcgctgtagcatagtctagaatacgatttatttttgtcatcaaactgtaatcagccaggcgtatcttttgattgcctttttaaataaacttccgtagaatagtaggacaacgaaatttttagtgaggtgattaagatggcatacgggttattatttggtggcattttcatggaagttttagggagctttttcttaaagcgcgcaaacggttttcggaacttaataccaacgataatggtgttggttggatattttagttcgttagtccttgtaacgcttgcaatgcaacgcctgccgttaggggtgacgtatgccatgtgggctggactgggcacgtttgcaaccgttattttagcggtcgtcgtttaccgtgaacggctcagtctctcacgtctgagtggcttaattgcaatcgtagtcggggcgattttactgaacatttaaatcaagggggaatgatgatgcgtgcatggattcaattagttattgcgattggcgttgaaattgcggggaccagcttgttgaaattatcggctggatttaagtaccccttggttggaattgtgggcatgttactatacggcctagcgatttttagtttctcacgggcattgagcaaaatcccactgagtgttggttatgcaatctgggccggagtcggcacagctgcgaccggcctgattggaatttgggcgtttggcgaaatcttgacgggattgaaaacgttgggattcatggcgattattacgggtgtgattctattgaacatgcctgctaaggcgactaaaccggctactgcgacgccgcgcttggcacggtggcggacccggtttaaccggtaactaaaaagatcgagaatctggctgatgttttaagcgattacgcttgaaatgcgccggttgattctcgatcttttttagttgttgtaattaggcttctgaccagacttccttagccgtaccaatgactaacgccaacttggcccactgttgagcctcagttaactggttaccttcttcagttgaagcaaagccacattgggtcgatagtgctagattacgcaatggcaccttagtggtcgcagcttgaactcgttctttgatcacagtggtcttttccaattctggaaacttagaggtaaccagacctaatacgatgcgtttgtggtcatcatggttccaaatctggtctaacgcttcgaagccacccgcccgttcgttatcatattccaagaacagcccatcatagttaagctggccaaggtagggtgcaaccacgtcgtaactgcccgagaagaggtacgtggatttaaagttaccccggcagatgtgggtcgtgacggtcaagtcgcttggcaggtcagctaatgctgcgttaatcactttaacggcatcggtcgcccacttagtgtaggccgcgtggtcagcttcgggatcattgagtttgctaattaagaaagcccacgtcgtatcgtctaactgaatatagcgacacccaaggtcataaaaatgttgaatggtatcgtgataagcttgggcgagatcatttaaataggcatcccagctgtcatagaatttggtccaattgtcactccgattatcacggaataacatagttggtgatggaatcgtttgtttagcgagtacgccagcgggaacgattgactgtaagtattcaaaggcagcaaagaacggatggtcgggattatacgcgactttgccaataagttcagcgttatccgttcgagtatggtcccccttgaacttatagctttgatggtagtcgtacttgccaacaccagttaagccccaaaggaaatctaagtgccaccagctgcgtgaaaattcgccatcggtcacggctttgagcccgagtttaacttgttcagcgaccactcgtttgatttcagtgtgttggatttcaagttcttgatcacgcgtaatggtaccggcggctaattgttcatgggcctttttcaaactagcggggcgcagtaggctgccgacgacgtcaaaacggaatggggcggttaaagttgtagttgtcattaaatatcaaactccttaaattttattgggaacgaaaaaacgtcgtcctgaataatattaatcattattcaggacgacgttgggccgtggtaccacctgagttctaggctagtgaactagtctactcgatacagctgccaaatgattggcaattgctaacgcgggtaacggttgttaaaccggctttagttaatgctggttactttgttgctcaccagacactcaccaaaacgaactagggagaagaccatcttcattggttgtgccggtaccgtttcaccaacccgatactcgctgaacagcgacaccaattactcatcttttaatcgttctttaattattgacacctatcatactggtaattattttaaatgtcaaatttaatttaaggccggaatcggtgggcgggattaatccatagtcatgctataatgcaagtaacatgcgattgggggcaaattatggatagaatcattcggttttttaagcgggatgacgttgacttgtacttaacgttggcgttattaatcatcattatttatttaatgcgcgggtttgcgacagttgttctattaacgacgatttttgcgtatttgggcattaagcttagtcggtggttaaacctccgaacgcacttaccttattggattgccgtcattgtggtctacgtcggcgtgattgcgttgtttatcggtgcgctatcgtacgcggcgcctaccctggtcgatcagttgaaggtcattccagatatgctggctaaagcaatcaccaatcacccggtattgaataagaatattgataaatgggtcaaccaagccattcatagtagtgaattgattcaaaacgggaaggcgttactcgtcaccggtattaaaggactgagtgaggttgggactggttttacgcacgtcttaatggcaatctttttgagttttatctttgcagtttcgcggggacgaatgatggtctttggccgccagttcttgcagtcgaagtttaaaaagttcttcacgaacgtttactatttaacgcataaattcgttatgattctggggcggattattgaaacgcaactggtgatttgtacgatcaatacgattttgatgacgattgggttcatgattattgggatgccaagtatcatggtgttgtcgatcattgtctttatcttaggcttagtgccggtggctggcgtgttgatttcaatgattccgctaaccttactggggtttgcgtcgggtggcttgattcgagttgtctggatcatcgtgttggttattttgattcacgccttcgagtcttatttccttcatccacggctaatggcggatcggactgatttaccagtctttgtcacttttattacgttgattattatggaaagtctattaggggcctggggcttgatcattgggattccaattgtttcattcttcctagacattttgggtgtgcagaattctgagccgcgacgcgtgacgtctcaaatagcgaaacgtgaaccttagtgtgattgtaactgtactttaccggtagcagactttgtatggggtcgggtgatttatatgaacagtagcttgtgactgcgcgtaaaggttatcaaagataattgtaagctggtatcttcgaagtggattactttcgaaggtgccagctttaattaattactgcttaaagatgctgatagtgacaattacaagtcagactgttagtgttaagctatcagcgttctaggtggtataaggttgacttatttcgactaagtgttagagtgagcggttggaatctgtttaggagggggcgattacgattaatcaatcaaataatcaacatcccgtgttagatggctggcaagaaattgaagctgaccaaattaagcgaatgcaaggtgcgttgtggcatttgttgggcaatgcgatagcatatttaagtctatttgtaatcgaactagtgcttgcaacgattggtcattcgcaatctttgcacgcggatgcgtttaataattttgcgggtattgtttcatcggggttgttatcgcttggtatctggggtggcattcataatcatcaatcacatcaaagtaaagtgaccgctttggacggctgggaggccgaacgtcgcaatcgattgatgcgatttcgtttacaagacttattcacgttaatgagtggggtcattatgttagttatggcggtacaagttattgtgagtggtgttagtaatttgtttaaatcacacaccgttcaagcagtgagcggtgtaactgtttggggagctgcaatcgcgagcatcgttatgttagtcgtctggtactttaatcgtcgcggtgggcaacaattagataattcgacgctattggctgcggcaaaggatagtcttagtgatgcgttaacgagcattggcactttaatctcattaagtggggtcttactattcaaatttgcttggttagatagtgttgcgagtatcgtgattggattctttatttttgccgctgggttacaaatttttcgggacagtgggttgcagctaattaattacagtgatccacaagttgaaaaaaattatattaatacgattcaacaaattgatggtgtgaatcaggtcaatgcaattgatgtccagtattctgggagcttagtggccttgtcgctggttatagcagtgtcaccacgaatgacagtggcagccagctttcagctcagtgaaagaatcgagcaagtgatgcgaaatcagtatggcattattgacactaaggtaatgtttatgccgcaaacataagtgtgttgactgatagattttaataataaaagactagtttcaaggttgaattccttgaaactagtcttttatttatggttggcgcgaattccgttgcggcgtgcgggcatggtggaccgtcaaattcgttagtgtggcgtctgttgctggtttcgtgaacaaaggaatcgtctcttccaagacatcgctaaacgctaagccgtaccagatagcaggagatggggtgatgttttgtagtagaacgcgaccaccaattagtagtcgatcgaactggcccatagttgggttgctagcaaggtccatgatctgctgattctgaacgacaaatttaaaatcgccaacttgacgaggttgtgtgattccgtaacgggaatattggggatcgatgctgtgatctgcaattaagttcgtgacaatttggcgcaaatataaattaatgtgctgtgatttacggaaacctaagttgagttgaacttccacgatatttcgagtgcctagcatgtcaatgctgtaactacaatcataaggtcggttggtttcattaatggtaataaaccagtaaaccttagcgcgtttaggccgcttatctaaaatcgagtacagaattgaccgtttaacccggtgttgatggtcgaccttagccaagtagactaagttcgttgcaaatactggcaggtgatcatcgtggcttagctggatcagttgattacgataatctagcagactaatctgttcatttgcctggttgtaacgcaaacgccggcgattaccaaagaaccaaacgaccataatcaagaaaatgacgagggtcagccccaaggtcaaatagccaccgtgaataaacttggtcagactagccgttagaaagacggtctccagtgcgccaaagccgaataataaagctagcgccagcgcccggtggcccttcatgtgaatccactggctaagcaggatggtcgtcatcaacattgttaaggtgatggctaaaccatacgccgcttccatgtgagctgaagtttgaaatagccaaacgattcctaaggtgaccagacataacagccagttgatcgcaccaatataaatctggctccgaacgttactggggtgcttgataatcatacgtggtaagaactttaaaccgactgcttcgtcaactaaggtataagagcccgtgatcaaggcctgtgacgcaatgatggctgcggccgtggctaagataatcattgcaatttgaccgcccgcaggaaccatggcatagaagggattgacattggtggcattgcgccatgccgcatcctgataatgggttaacatccacgcgccctgaccaagataattgagaatcaaagtcgtgtatacgaacggccaagtggcgtcgatgttggctttaccaacgtgacccatatcagaatacagcgcttcagccccggtcgttgcaaggaagacactaccaagaatgaaaattcccattttattagccggattgaataagacttgtacggcgtaaacgggtgagaaagctttgagaatgacgggtgcctgactgatgttgatcagaccgaagatgccgatgacggtgaaccagagcaacatcatgggaccgaatgaccggccaacgacggcagtaccaaacccttgaatcataaagagaaccagtaaaataaccgtaacggttagaggcacgagccacgggtactgggaaaaagcccccagtttgggtaatccctttaagccttcaactgctgatgtgactgtcacagcaggtgttagggtgccatctgctaacaaagcggcgccaccaatcaacgcgacgaaaattaaccatttggcccggtgacgaaccagcgcatacagggcgaaaatgccaccttcatgatgattatcagcgcgtaaagcaatcaggacgtactttaccgttgtaatgagcatcaacgtccaaaagattaatgaaacactgccgataacataatcaggtgttgcattcttaagttgccccgcgtcattgatcagggcgttcataacgtatagcggtgacgttccgatgtccccgtacacgacgcctaatgtgattaacatgccaatcaatgaacgttcctgaatccgttgcttacgcatgaattattgacccccacttcaattagaactgtgactcatactatactagcttttttcaaaaggggttaaccagacaaactaaaaatttgctcatgttaacaagtttcaacttacgtttcgttaggtgaactttacttcaagttgagtacaataagtaatccggttgttcgtatttagaggataaaaaatgggccgtttcattccagttgataacgctgaaatgaagcgacccattagttttgaatttattagtctagtcaattatttctcatcagtggctgtattcgtcttcaactgggagtgtttaacagaatagccaaagtaaacgaccataccgatggctaaccataccacgaagcgaatccaagtgacaggcttcaggttgattagtaggaagacacaacagatgattgacatgattggtacaaacaggacccatggcgttttgaagggacgccgaagatctggttgtgttttacgtaaccgtaagatggagaaggaaactagggtaaaggcagtcaaagtaccgatattcaccagttcagctaagtcagctaatggaatcaagccacccatgattgcggcaatcgacccaaacaagacggttgatttaagtggtgcaccggtcttggcgctaatatcgctaaagacatgggggagtaatccatcccgcgacatggagaaggaaatccgagtttgaccgtagagacagactaacattacagtggtcataccaagaatcgcgccaaggtcaatgattccggccatccaattttgaccggagtaaataagaacggccgagatcggatgatcaatgtacttggcaaacgtttcaaatgggaccacgccagtcatgatggctgatacagccacgtagagaatggtacagataccaagagacagtaacatggaacgtgggagtgttttggatggttccaatgtttcttcaacgctggatgaaatggcgtcaaaaccgatgaaggcgaagaaaacgctagaggctgcgccgaagacccctttgaagccaaatggtaataacggactccagtttgccggtttgatgaagcgcaccgcggtaaagatgaataaaagaacaacggctaatttaatcactaccatgacgttattgacgcgtttagtttctttgaccccgagagacaataaagtggtaatcaggataataatggtgaaggccggcagattaaaatagctggtcacaccagggacggaacctgcagctgccgacaaagcagcgggcagtttgaggccgaagcccgccaagaatgattgaaagtagcctgaccagcccgctgaaacggttgagacagcgaaaaggtattctaacatcaagtcccagccgataatgaatgcaacaatttcgccgagggttgtgtaggcataggtgtacgctgacccactttcaggcaccatcgcagcgaattcagcgtagcagagtgaagcaaacaggcaagcaattgcagctaagacgaatgagatcattaggccgggacccgccgtcaaggcccccgtaccagttaaaacgaagatcccggtcccgatgatggccccaattcccagcatcgttaggtcaaatgttttaagttcctttttgagcggactgtgataagtggctaacattgcattgatatcttttttgcggagtaaccgcgtgtgtgataaatccataatcatcgccccatttcgatgtgatagctttagtttaatcggttttgacaaagttacgatggtcaatccgaccaaaataaatattctgatgggctatagtgactaaaagccaaataattggacgcaatcgcgcgacatcctgcgacttcttattgattgtctgactaatcgtgattaattagctacggtattcaacgcctattaatagggtgatatagcgaacatggcggggattgtttttctgaaggttaacttaccttgtgattgcgattgttagtggggattattgaaggaccttagaaaatatggttttggctcactaaatcgccacttgattgatgcaacctgaagaactggagagagtgagcggcttattggaacccttttttattgatatcgattatatgaataaaatgggattatgattatccttaaagtattttgatgaatcaaattggataattaattttcttgcaggtaaaacggcctacgggaaactgatgtgactcgtctcgaccttccaatatcaacatttattgaccacatttgcataaattttattattccaaatacaaacttgattgcaattctaaaattaacaaatacgaatgatattcattagttggtgacaatgggtttggcgtttgctatattcaaaaggagaacgcaaatcaaggcctgaccaataataaaggccacttgaaattagtggactactgggtctgctgattgttgctggtatcgaagctagtgattgcaatgactggcagatcttgaatcaaaaaaggggatagcaagctgattggtttggtgttggtaataaaagtattgatactagtacgtctgcattcataatgtataaagcattgccagactatttccagataataaagttgggaggcattagtcatgtcgtcatttcttaaagcaaagaccgttacacattacgtgctttttgcaattatccttattagtagcttctgtttatacgggtacgttaaaaatcgtattgagttaaatcaagcgaggactgtactaacaacaatattaaaaagcagtccttatgacgtgcgtgtctcgagaaacacaataatcaaggaagaatccggcccttttagcggcattatttggtatgaatacacatttgcaaccagccaaacattagcggaaagtaagaaatacaaaaagtttttgcatcagtcatcaaaaaatatgaccctgaaaaattgccccatcgtctatcgcgtaatcgttagaccgccgactaaaaaaataaagcattggacgggtgaaatctatctcgataccaatcaaaaactcagcgcaacgggacgttcgaattacgtccaagctttaagcgacaagtctttgtgtgaactaacgatttcataaaaagccattaaccaggtggttccaatgatttagtttactatcggcctacattgaaaaatggggtaggtaatgcgttaactcaatcaggccatacaacagatgttcagaaggggtggtcgaatcgagttgtgttgattgtctaatcaacgcaacttttttatttgaggatttaacttggtcaaaaatatttgttatgagtttctccagtggtagcagaggtatactgcaatgattgaataaaccgatccgtaagataatgacccacaaaaaaacagctgggagacttcaccagctgcttcaaagatttgatttattaacgatgtcgtcgatagtaacggtagacgaccgctaataaaataataattagtaaaataccaacggccgctcgcggacccgcaatgtgttcggttaagtgaaacatgcgaatggggccgaggccgtgaattccaagcattgcaagcattgaacgcgccctccttaagcataattattagctatttaatgattaaatgcaaaaattatattcgcaaaagattattatctcactactatctgcggtaaaataaaaccatcattaataaattaggtgggtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcttttgtcggtcgtaagttaccaaaaaaccggttatttcggttacgtaaagagacgcaaattagactcgaacagatgattcagcggcaacgtgaagccctgggaacggaattgatgcccgcagatgcggtcactagttcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagattggaaatgaattattacaccttttagagcggaaagcagcccaaggcgtcgacgttcgtgtcttgtacgatccgtgggggtcgatgggcacgttccgcagcttctttaagcatttagaagaacttggtgggcatgcccgaccgttcttgggtgctcattcagcgattttggacttccgtctcaacttccgtgatcaccgtaagatcgtggtaacggatggccgggtcggctacgtcggtggttttaacgttggtgaccagtaccttggtcgtagtaagaagtttggttactggcgtgatacccatttgcggatcgtcggttcaggagtttttgaattgcaggaacgtttcattcgtgattggaacgccaccgatgcggaacatcgaatcgtgccagacgttaatatgttcccagtcattcgcgttaaagggaatacttcattacagatcgtctccagtggcccggacagtgatgcacaacagattaaattgggttatattaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaactcagtactatgcccgggagctggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgatttagcacaagaattggaacggattttcttagaagatcaaaaaatcagtagtttgattaccgttcaagactttaaaaatcaatcattctggttgaagttcaagcagacattttcacggttgttatcaccaattttataattaaacaattgaatagatgatgcaaaaaaactgattttggaaagttattgactttcaaaaccagtttttttagtgttccttagtcgttcaagtacaattggcgcaaattattaatatccgctacggataacccaagcacttctcgtaaataaccaataccattgccgtagaggtcgtcgaaaacccgaaagaccatcttcatattgtcggcttcaacagccatggcaacgttgaattggctagctaggtcaccagcattggccttggtaataatcgtagcggtatccatactgtctgcggccatgaagacggcgttagtgagcaggtagtcctgcataatcgtttcacgggggacgtctagggccgtcataatgagcgcacccgcgacccccgttcggtctttaccagcagcacagtgaaagagtaccgattggtcgggctggtcgttggtgaggagggtcgcaaataaattttgccagactttcacggcatgactatccgtaaccatttgcgcatatgtttgtgcgttgaaggaatcatcgacgaccattcgcttgatgagccgttttaaacggcgatcaaagcgacgattgtcagtgaacggatagacagacgtattaatatacttagtattcttgggataacggtctggagacatctcagcttcattggcttggcgcagatcgatatcataacggagtccgtagttatccaagtaggtgagatcgcggttagtgagtagtgacatgccaccgcaacgcagcagtttttgccacttgattgtctgaccagcggtgttctcataaccccccagttctcggaagttgatgccgtgttctagtcgtaagacccgattgtgttccatagtctgattacctcgattagtgatttagctttattataaccgctttcatttccggtgtcagggtaaagtgggtgcaaaaattagaattggatactaaaaaaactgtcagaccagaattggctgacaagtttttttaggtattagtgagacttaattagtccccgttgtaaatcgaatttttaactaccacatagtcgcacttagtaatggcctttaaatcccggccaccggcatatgagatggatgattgtaagtcttcttgcatctcgtttaaggtgtcaactaagcggccccggtaaggaaccagcatttgtttaccctcaacgtttttatgttcgcctttttgagtttcactggcggaaccgtagtattgcttataagtcttaccatcgatttttaaaatgttgccgggtgattcttggtgtccggccaacattgagccaatcatgaccatcgtagcgccgaaccgaatcgacttggcgatgtcaccattggtccggacaccaccgtctgcgatgattggtttgcgagcggccttagcacaccaccggacagcagctaattgccagccgccagtaccaaagcccgttttgactttagtaatgcaggccttacccgggccaacgccaaccttagttgcatcggcaccagcattttcaaggtcgcgaacggcggctggtgtggccacatttccggcaattacaaaactatccggaaggacgtctttgatgtgcttgatcatcgcaatgacactgtcagcatgaccatgtgcgatatcaatcgtgatatattctggcacgatttgattagtagccaggtcgtcgataaagtcatactcgctggacttaacaccgaccgaaatagatgcgtacagttgcgcggcatgcatcgtttcaataaaagcacggcgggtctcgggggcgaagcggtgcataatgtagaagtagtcgttagtggcgagccacttggcaatctcgtcgttgatgacggttgccatattggcaggcaccactggaatcttaaaacgacggccacccaattctacggtcgtatcggcttccgaacgactattaatgacacacttgttcggaattagttgaatatcttcgtaatcaaaaatctccatgcccatgatgcaaaactcctttaagttaattcacggtgtcacgttcaattagccccaaatgttgtgatcgataacgttagtttgttcgcgatcgggaccaacagagaaggtggcaattttaacgccgacgagttcttctaatttacgcaagtagttctgtgcattagttggcagttcctcaaaggttttaacgccagtaatgtcttcgtcccagccaggaagttcttcatagataggtttgcaagcttctaattccttcagactagcagggtagtgatagatggtttcgccgtttaagtcataagcggtacataccttgatggtctttaagcccgtcaagacgtctaagcagttcaaactaagatgagtaaacccagaaactcgtttagcatgccgtaatacaacgctatcgaaccaaccaatccgccgaggacgtttagtaacggtcccatattcatgggccgtttcacgaatgaaatcaccgacttcgtcaaagagttcagttgggaatgggccgtcaccgacgcgggaagtgtaggcttttaagaccccaacacagttatcgattttagatgggccaacaccgctcccaatagtaacaccaccggcaactgggttagatgaagtaacgtaagggtaagtcccttggtcaatatccagcatgactccctgagcaccttcaaataggacgcgttgaccgttatctaacgcatcattaatgacaacggaagtatcggtgacgaatggtttcaaagtttgaccataagcgtaatagtcatcaaaaatatcttcaaatttcagtggttctaagtcataaagcttggtaataatttggttcttttcagctaagttgcgcttgagtaacgccgcaaaggtgtccttatcaagcaggtcggctacgcgaatcccaattcgttcagccttatccatgtaggctgggccgattcccttattagtcgtcccaatcttgccaccggctttagctttttcttgagcgccatctaatgtgatgtggtaaggcaagatgacgtgtgcacggttagagattctaaggttgtcaggattaacgcccttgtcccgcaagtattgtaattcttcaactaatgacttgggatttaagaccacgccgttcccaatgacagctaacttatcatggaagaaaatccctgatggaatcagccgtaatttgaaagtttgcccattaaatacgatggtgtggccggcgttatcgccgccttggtaacgtgataccacatctgcttcctgactcaaaaagtccgtgatctttcctttaccttcatcgccccactggctacctactactacgactgatgccatattcttccacctcattaaatagtttaattatgaataattaatcctaaagagtagttaaacgttcaccactccaacaggaaagagtatagcaactttaacgtcaaaacgcaacccaaaaaccgaatgttcttgttttgagcacaaataatcgttcataattaaggtgaattagttcgaaaacaagtccttaatatggaaacgaagtgaaaaataacagtattttttcattgttcgtctctattaattactcgaggggtatgctataataatgttcgtgttttgttagtgaatacctaaaaagaaatgaggattagcaatgattgatcgttatacgcgtcccgcgatgggcaaagtatggtcgttagaaaatcagtaccaagcatggttggaggtagagattgctgccgacgaggcctgggctgaattagggaagattccagcaagtgatgttgctaaaattcgagagaatgccaagtttgatgttgaccggatcgcggagattgaagccgtaacgcatcatgatgtggttgcttttacgcgcgatgtttccgagtcgttgggtgcagaacgtaagtgggttcactatgggctgaccagtactgacgttgtcgacacggcgcaaggttaccggttgaagcaggctaacgcgattattcgccaagacttacaagatttacgggcgacactagcacaacaagcgaaaaaatataaatatacggttgaaatggggcggacacacggcgtccacgctgaaccaaccacatttggattgaagattgcccggtggtattctgaaattaatcgggatatcgagcgttttgaacacgcggccgcaggcgttgaagcgggtaaaatcagtggggccgttgggacttttgcgaacattccaccatttgttgaagaatttgtctgcaaacaacttggattgcgcgcacaagaaatttcgacgcaagttttaccacgggacttacatgccgaatacattgctagtttggccttgattgcaacaagcgttgaagtgtttgcaaccgaaattcgtggtttgcaaaaatctgaaactcatgaagttgaagaattctttaataaaggtcagaaaggctcatcagcaatgcctcacaagcgtaatcccatcggttctgagaacgtgacggggttggcacgagttattcgcggccacatgatgaccgcctatgaagatgtgccattgtggcatgaacgggatatttcccactcttctgcggagcggatcatcttaccagataccacgattttagtggattatatcttaactcgaatcaataagattattaagacgctgacggtgttcccagaacggatgaagcaaaacatggatgcgacttacgggttgatctacagtcaacgtgtcttgctcaagttgattgatacggggatgtctcgtgaaagtgcttatgacctcgttcaaccactgacggctaagtcatgggatgaacagttacaattcaagccacttgttgaaggtaacgccgagattcgtgaacatttggaccaggctgcgattgatgatgcgtttgactatcattaccatcttcgccacgttgatgatattttcaaacgattgggattagacgattaatttaaaaacgatgaagccccagcgatggtaatcgctgaggcttttattatgattaaaacgtgttaaaaagatgggctgtttattcgtcagccgatgcgcgtcctattccggcctccagggctggggacgattactggctatttttgagcttgataatggcacggtttaatcatgcttcatactaaacgataactagcgcaatgcgtgtaagtaccttgatttcagttcaagggaccaaatgttaggtgcgtcgcaatcagaccatacccaagtgccatatgacgctgttctttgcgcgtgaggcgctgtaattgggtgtgaacgtattggtagaggtcacgatgctggcgtggtagagtcattgggaccatatagttacgataataggcttgatatagctggatggttacttgctgtggcgaaacgttgttattcaggtcgattgcagctgccagtagcgcttggcggtaggaatcggatggttgattggtaatcggctgattataagcagcatctactaaggtaaataatttttgagcatccacatccattgttaggaccaacctttcaatcgttgagataggcgcaattatagcatggtcagtatgcttgatgtgcaggcccgagttggtttctaaagtaatggaacgaacataaccagagccgccaatgagtgggggtcattggcggctctggttattaataagggattaatcaagcggcggtcgcagcagtgttttctgttttaagcccggtgccaagctgcgtagccgatggttgggaaaataccgatcaaacggtcgattttttcgcggtctaattgatattcgatagctggcagtagtgcgttgacggcatcttcagcttgatcactgatttcagtcacgccaacgagatggccgtcttggtcatggacctgtttactagcggcaatcggttccttggagacttgataataccagtaatctgctaaatcgttatcactaatggttaagccggccttttcagcagccggtattttcatgccggcttgcgcaattcgtggtgaagtaaagacgaccgatggaattaccggatagtcaatgggagcactggtttgaccagagaacaaacgcatcaagtatttggactcaaaataggctgcaggtgtgacctttggcaagtcattggcaaggacatcaccggctgcatagatgttaggaacgttggtttgcaagtgatcgttgacataaacgccgtggcggtcatatttgacgccaatctggtctaagcctaagccatctaagtttggaattcgaccagtcgcatctaggatccagtcggtcgttaattgctggtggtcgccataactaacttggaactggtcatcctgtttggtaaatgcttgcacgttggcatttttgatgaaggttaccccacgttcggttaagtcgtcaaccacttgtgtaacgaatggttggtaaaaatcacggagggcctggtcgccatgtaacatgactgtcacttgggcaccggccgcgttagcgatggtggcaaattccataccaatatagcctgcgccaatgatgacgatactttgtggtaaccgtttaaggttcataaaatcactactatcgtgggcgagcttggtccccggaatatctaaacgatggggctttaaaccagtcgcaataacgattttttcagcggtaatggtttgctgatcatcaacgacaacggtgtgagcgtccttgaacgtggcatgaccatgaatgatcgttgcgccaccatcttccaaacgagctgtcaggcctgctggtaagggatcaataatctcttgtttatgggccacgttggccgtccaattaatggttggtgcactgctcaaaatatcattgaggcgtgctgcttcccgcgttaatttgacaggttcatcaagagtgattttggcgttacaaccacgattagggcaggtgcccccaatcagaccactctcaatcacaccgacgcgaacaccagtcttggcgagtggtgcggcgccatcaaacgtggcgtgacccgcaccaatgtataacacatcgtaatcgtatttgtttgtcatgatttatcagcctccattaaaattttggtaacttaagcttaacgagttttaagaaacctgacaactgatatgaattgctcgcgcccgctgtaatgattatactaaaagtaattatgtcaatagggagacgttaatatgcacgctttgatcgcaattgattcatttaaaaattccatcacgagcattcaggccaaccgaatagtggctaaacgatttgcggctcacggaatcaccgctactcaagttgcgattgccgatggtggtgaaggaacggtggcggcgtggctggctaaccatgctggtggacaagctattacggcatcaacggtggatctggcgcaacggtcagtgactgcaacgtatggctactttgccactgaaaaaatggcagtgattgaggttgcggctgcatccggaatccagtttgtcacgacgaccttgacgccgttagcaacgaatacctatgggaccgggctactgattaaagatgcgattgagcgtggcgcccgtcagattattctgggcttaggtggtagcggaacggtcgacggtggtgcgggaatcctacgtgcgctcggttatcgtttttgggctgccgatggtcaagagttatccatgactggcgctgatttaagtcgggtcactaagattgacgatcgacatgtgttgccacaattagctgaagtctcgttcattagtgcagcggacgtgacgaatccgctaacgggaccgaacggcgcagctaagatttttggcccacaaaaaggattaccggttgctcaaattcaggttcacgatgccgctttagctcactatatgacggtcgcagctggtgcggtgagtgcccacgaaggcgatggggctgccggtggtattgggtttgcattacgttactttttacacgcccgcgtttgctctggttttcaattgttagctgaaatgagcaatcttaaaacgaaagtggcccaagcgaatctagttatctctggtgaaggccaagtcgacgatcagagttttatgggcaaggtaccaattcagctcagtcagttagcccaagcggccggcaagccttgctatttattagttggtcggcagaaaggtgcaaatgaaacatttgccaaacagggggtcacggccgttttaccgattgtcgatcaagtcatgaccttagatcaagccatggcgcagggaccagccaatctggaacggatggcggaccgcttagcccgaatcattagccagtcataaaaaacttaagcggtcaaaaaaaccgtatgcgtagtgaatagcgcatacggtttttcgactgaattttatttatcaggaacatagtgatttaaaaaggctgtaacatgtcgttgatactcggcaggatcgatccaaaaactctcggcgtgagtggcgttgggaacctgccacatctgcttggggcccttagcggcctgataattttctttgagcatccaacttgggacgtagacatccttgtcaccgtgaataaagaagatcggtagatggttatgtttgagctgttcgacagaactgacgtcgcttaaataatagcccatacggtggcggttaataaaactaacgatgggcacaaacggatactttggtaagtgaaactgtcgctttaataagtaagcgagttcttcctcgatactcgaataaccacaatcggcaatgatggccttaacttgtgatggaaggtcttcgccgctcatcatttcaacggtcgcaccacccatgctgacaccaaaaaggatgatatccgtgtgacgaccattgatacggacgactttatcgatccagcctaaatagtcgcggcgatcctgccacccaaagctaatgtacttgccggcactttgcccatggccgcgatcgtcgggcaagaggacgttatagcccatttgatggaacatataagcgtaatttgccatcgtttcaccatcacctttgtagccatgggaaacaataacggttcggttgctggttgttttagcaggaacgtactgtgcgacaaggtgattggcctcgtcattagcgttcagttgccactgctgaacgggctgtcggtgtagccaatcgacataagcgtagtaggcatcggcgtatttttgtttatctgccgaagtttcgggcacgtaatcaacacgcttgaaagcaaaatcgtagagcttctcactcgcgaatagggcggccgaaaaaattgccacaggagcactaattccggctacggcgcgtgtttttttcattaaatatcactcctctaatctctcaataatatgatacgccgattagaagtgagatgtaactatattattctagtaatataaaaggccatcgcggcgggcgatgacctataaattgcattggtcgctaggtggcatccccagcgagcctgtttttcattaactttggaggagtaaatgaaaaaggttcaagtggctgaaggagatgtccagtcactatatgtttagtatagtagtttgattgttaaaaggtaactaaatcgcttacttgactggtgaaaaaactaaaaattatttgtgggtggtcaatattccggtatggacagatttcgtcgtgccaagtatgataccgattcaagtcgcattaagcctccttaagggctagttcatgcactttagtgctaacttgattaaggacctgcgttttacgttcatctgtcaaaaagacgcgctgacttaaaattgggtagtgttgttcacgtgcgattagcaataattcacgataaagcaaagtggcggctaatagcgatggccgggcgacgggatcaatttgtggcatcatggttaatgcagcctcgtacttgttcatggcaatctgtgcttcatgttcccaaagccgaataaaattggcagatgggatggggccatgcaagtcagttggattgagctgatagtgtgccaatagttttgatggcaggtagattcggccacgttggtagtcttcaccaacatctcttaaaatattggtgagttgcatggcgctgcctaattctacggctggtttgacaagtgattgcgggttagttgctagcattggcaaaatcatcagaccaaccgatccggcgacgtaatagcaatagtcttcaagtgcttgctgagtttgaggttgtttaaaagtcgcgtcttgttcttgaccagtgagcatatcgaaaaagacgtcaagattcatatcataagtctcaaaaacgacggccagtgcgcgccacattgggtggtctgggacatgaccattggcaaaggtggtcaatgattggcgcaatgccattagaccatcaatatcatggtcaacatcaacgaggtcgtcggctgttcgacaaaaagcataaacggcgtaaatactccaagcgcgttctagtggtaattgcgagaaggcggtgtagaatgcgctagaagaccttttagtaattgtttgacagtacgcaaagtcagtgcgatgttgttcgaatttaggcattagtttggtcatctttaatcaactcctcaacggctaatttagcactttgcataacaatgggaacaccggccccagggtgggtgctactaccacaaaaataaagatggtcggcatagtcgaacttgttatggggacgataataattactttgttttaacgtcggtcgtaagccgaaagtggctccgttataggcgccaaactgttctttgaagtcaaccggtgtaaactgcttttcgacaacgatatgctgttcaatatcgctgaaggtagccgtttgtcttagtttgttaatgattagttgacgatagttcttcagtgttgttggtgaccagtcattaaactttgagagctcaggaactggtactaaaacatagagtgcctcactgttttcgggagctaaacttggatccatctttgatggaacatagacataatacgagggatcttctggtaacttgccgttgtcaaatagatcggcgacgtttttgctgaaatcttgtgcaaagtggatcgtgtgtaatgcttcggttgggtattttttgtctagtcctaaatacaagacgagacatgagcatgaataatccattttggcaattttttgatctgtgtactgaccacgattttgctcatttggaatcagtgtcgtcatggcggttggaaaatcagcattacataggacatagtcactgtggatcggatgattattgacacgaatgccaacagcaactttatctttgatgataatttcttgaactggtgtggcaagctttaacgtaccaccctgttctttgaataacttaacgagactattgacaactgtgtacataccaccctttaaaaaatagaccccgtagaagagctcaatcatcggaataatgttgtatagcgacgggccctggtagggagaaatcccaatatacagtgtctgaaaggctaatgaattacgtagattttcattcttgataaattttgcaatgtttttgtaggcattgttaaaggtgcgtaactgtagtcctgcatacagagcgggtaggttataaaagtcacgccagttacgaaatgatcgttctaaaaaattaggcttcgcgatggtataccggtgataaatatccgctaaaaaatttaacataccattgacgtcatcaggcgcaatgcggttaatctcggcaattaatgttgggagatcgcgtgacaaatctagactagattgatcaccaaagacaaggtgcatcaaaggttgaacttcttcgaatggtaaatagttgtgcggatcgaccccgcaaaagcgaaagacttcttcgtagatgtctttcatcatgacgatcgtcggccccacgtcaaatgtaaatccttggctaacaatctggttcattttgccacccggttgcgcgttttgctcataaatcgtaacattataacctaatttttgaagccgtactgcagcggttaagccaccaataccagcgccaataatcgatacttgcttcatcagtaaatctcccccttaacagatgaataactaaaaagcatggttaatcattagttatattttggtttaataatgtaaaaagtacaacaaatatgattactatgacgtattaaagtagtcggtaggtgcgaatagagcggacgagaaaaacaaaaaaaccaccgtatcggggaatacggtggaaaaaggagtagggtaaacatgtgacggggaatcacatgttactatgaatttcattactttggaggagtaaatgaaaaattttaggttgtgttatagctgattgagttaacctcaattgctatgatgtaatcataccgaggttgtgtgaagaatttgtgactgaacatggcgaatgtcatgaaaaaaagggaaaggctttattaagaagtgtgaagaatcatcaacgttcttacggaatgccttggcgaggtgcgatgatcgactgtttggggccaaagaaaatagtcacttcaaaagttgtcctttgaagtgactattttgattcgcaatcaatgctagtaataacaagtttgcggcgacgctaagttgatagtgaccaagcagattttggtgactggctgtgggcactgccatttggcgcgattagttatcgtcacgattaccaccgaatagaataattagtcgtagtaattgtaagaatgttgacagggctgcagcaacataggttaaagccgccgcgacaagcactttacgcaccatgggaacttcgtcgcgagtcaaaacttgcccatcagataaaatctggagggcgcgtcttgaggcgttgaattcaactggaagcgtgacaagttggaacaataacgccagtgagaagagtaaaatcccaatgtgaatcagtgtttggttgtaactcaataaaacgccgataatgattagtggtaatgataagcttgaaccgatgttcgtgatgggcacgagggcggtccgcaagcgcattggccaatagttaacgtgatcttgaactgcgtgtccgcattcgtgggccgcaactccgatggcggccacagaggttgaatctgctgtggcttctgataggctgagaatcttagtttgaccgttgtaattgtcggtcagatccccgcttatcttttggacaccaacatcattgataccagattggcttaaaataaagcgagctgcatcggtgccggttgtgccagattgactacgataggcatcataatgccggaatgtccgattaacgtaacccgatgcggccattgagataatcagtccaatgatgactaataggtaagtcggatcaaaaaacgaatagaacaaggtcgacccctcctaagtggtttaatgttaatccgattctatcagatttagcgtgacattcctactgaagaaagccattggaaagtgtctttactatcgagaaacgacgtcagattatataattagcccagttaatcgtaattggcaaagagcgaaggagttttctgatggaaaagacgtatcgaaccaaaacgtatggggaaatgccgttaaagttagatactgggaaaggctggatttttcctaaaggtgttgaagtgaaggcgcatgttgatttagaaacgggacaggtcagtttttttattgcaccagaagatctcgataagatgaaataagtattaggaccacgatacgcggtaaggttgagaagtttgtttctcgccttggcgcgttttttatggtggaaattggattggcaatgattatggttaatacggtgttcacgcgtgagccacaactacttgaaggcaataaaaaacctccgtatcggggaaatacggaggaaaagggaagtaaatcggtaaaatgtaattaagtacacacacatcattacttggggaagtaatcattaaagttagggggtcgttaaggattgggatttccttaatgactataaacatagtatagcggcgacgcgtgaagaaagtgtgacgcgaaaagtttaaaagcatgattttcagacgaaaaagttaggtcatggaacgaaaaaatatgacgatttttacaaagtttataacgaaatgatgaccgtcataaatcaatatgagtggctaaatgctggtgtgacgcagtttttattggtcctagactctgaggtgctataatgaagcacaaattaatcgaaaggtgttttccaaatatgacaattaaaatcgtcaccgattcgtcggtccaattaacgacggccgagattgcacagtataatattaaagtggttccgttactcgtggggttcggtggcgacttgattgcagatacggcagttagtaccgcggaatttgaccaacagatggcagtcagcccagtcttgccaacgactagccagccgccaattggtgatttagtcagttgctacgatgaattgacagcggatggtagccaagtattatcactacatttgacggagacattgagtgggacggtcaatgctgctcgccaagctgccaaacttgctagtggcgatgtgacagttattgatacccaggcggctgaccgtgggatggcctttcaagtgcttacagcagcacggatggctcacgccggtgcggatatggccacaattttggcgaagataaccgtcattcggcagcatactaagacctacttgttcgtggatacgctcgacaatttggtcaaaggtgggcgcgtccctaagttggctggcatggtcacgaatttgattaaattaaaatttgtctttgaattagaagccggaaaattaaaactttatacgcgggggcgcgggaaaaaggcgctaatcaaagcgcaggaacaaattctagaccaattagcggatgcgactcgagtcgaagcggctggaatttcttacgtcggcgaaccgagcgttgcggaagcgccagaaaagcttctccaacaagtcgttccacaagtaacgccactggttgcgcgtactagtccaattattgcgacgcacaccggtgttggcgcttacgcattgatgttttatacagttgattaaatttgacgaactaacctactattaaaaattactttgatgtgttataattaattaatgataaatgagaaccgtgttggtgcactgttctgagcctaaccaccatttaatgatgactagacccggatggggcaccttttttgtcactcttttcactaaaagaaagtaggaacttatgtgagctatcttctcaataatccgtttttcgggatcggactgtcgatcttggtgtatgggattggcgagtatttatatcacaaaacaaatcgctttgtgttattccaaccgttattttttggaatgctgctcgggattggtttattggtattgattgcgtcgattctaaaggcacccgtgcaaaaagtttatgaagcgtaccaggttggtggcgactggttattctggtttgtggcgcccgccaccgtctcgtttgcggtgccactatataagcgtaatgatatctttaagaaacattgggatgtcattgtgattgcgttagcgattgggttagggctgtcattatttggtatctatgggatttcacggttgctcggtctgacggatgcagcgttaggtgccatgttagtacaagcagcaacgacagcaattgctttaccggtggctgagtcggtgggtggcgatcaagccattgcggcgttcgcagtcattctgaattcagttttgatttacgcgttaggcgaccattttattcgctggttcaaattgcacaagaatccgctcggtgccgggttaggattcggaattgccggtaatgcggttggtgccactaaagcgattgaagtgagcgaggctgcgggcgcaactggtgcaatcgcctttgtgattgccggtattcttgttaattttatggttccagggtttgcgcagttgattggtttaggttagatggtccgggagggattcgatgaaaaaaggcgcgtttattacacaaattgtgatttatggtttgattttattggctagtagtttaattgctaatttagtcaataagatttggcccgcattcccaatgccgacaccgttgattgggatgattctactatacttgctgttaacgtttaaagtggtcaaacttgagcaggtggcgggtgttagcaactttttcgtccaatttatcagcttgattttcattccatcagggatcgcgttagtaactaagttagacgtgttaaaggcagaaggcgttcagattgtgatcgtcattattgtttcgacactaatgttgttgctttttacagcgggaatcgcgtgggttttaattcaagtcaaggaatggttcattgctcgtcgaacgaacagcaatgttgagttggaagaagattaaatcttggtggcacataatttactcgtgagtagattgggtaccagttggatctaatcgaaacaggcagttgttgaaccgcttgttttggctattacaagataatagcaggccgttgtggggattgcatacccatgacggcttttttagacggcaataaaaaagccaccacatcagcggatgtagtggtcaaggagtaggaaacatcaaagtgggggctttgatgaaccccattcatcagacttgggggagtctatgaatgaaagtgattattagctgcattatggcagcaacgcactaataatcgaaaaaactaaagaatattaaggattgacagtcagttggtcactttctatcaatctgcgactattataattgcaaaagttattggctgcaactaattgagctgattaattagtttaaagtaacgcggggctggaaatcagccgcaaataagcccatgtgatagaggtcgattcgttgcccatcacgcttgatagcacgcttattggtgccctcaaattcaaaaccactattctggtaaacagcgatagcggcggggtttgttgcgatgacgtccaaacagactttgtaaagattcaattcgttaaaagcgtagttcaaaatcaagctgagtgtctcggtaccataaccatggccgcgttcgtcgggatcaccgattgcgatggctaattgggcaacctggttatgccattcgatattgaatagggtgacaaagcctaataagtggtcgtcttctaaactatgaacgtgaaagtagtattcggtattccgatcaaggttacggtaagttcgttcgagttcttcaccggtcagtggtcgggcggcagccgtatccattttacgaacaaaatcggcgtcagtgtaccagtcactgatctcatcaaaatcttctggctggggaacagcaagggccacatgggacccgacaaacatatttttcaaaataatccctcactcgtatgatgttattaaagcttatcttcatggtggcggcaaaaggtgggcttgtcaaccaaaaattatgagattacgcgtcagactagctagctcagtatgaaacacgggtggcatgtgccaagtgctgatgtcaagaacaactagctctgggggacggcgaaataagatgcggatatactgaagacttacagtaaagccgttgggcacgtgctgccgataatgtggtttcagtataatgagggcaatacgggtgatggctgaactattggtgaaaggtgttgctgtgggggcacttttcaatggtgcgtaaagagaggttagcacaaactttacagttactttatatgaagattggtaaaactttacgttagctcgctatattagagataaccatctggtgattaaagtatgagagggaggatcgaattgcgtcctttacaagttattcagatttctgatctacatttaaccccccgcggccaagtaccggcacatggtcagcagtacgatccctggggcaagcttgccaatattattgatgatattcggcgattaccaaccatgccagatttgattgtttttaccggggacttgattcatgacggtagcgctgacgattatcagcggctgcacgcaatcatccatacgatggaagctgaatttgattgtcatgttcgagttatccttggaaaccatgatcggcgagcggcgttttacgaagggtatttgccggctgacccgggaccatactacgcgagtcgcatgcggattggcaacaacgacttttattttttggattcaaaggttagcggttatgaggcaggctggttggcaccacaacagctacaatggttgggaaaacatctacgacaggcaccgacaaagcgggcttttctatttttgcatcaccccctagatgggccgacgatgacaaatatgcactatgcgattttacaaaatacgccggcgctgttatcggtgcttcggggacataatttaggcggcgtattctctggtcacgttcactttgtttcaagttatttgattggagataatattctgaatgtggtggccggttctgcggcctatgcgatcgattgccatgatccacatcatcattatgttcatgagggcagtagttaccaaatcattacaatcgatcgaggacaggtcggtgtgacaacgcgccagttactgcatgggaaagcggttattgatgaattgacgatcccagacactaagtttgtcgggcgagccccacaagggtatgaatcaagatagcgctttcttaattaacaaggtataatgttggtaataattaagggaggcgtcaatatgggactatttcgtcatcacaatcaaatgccaccacggatcaaacgtaaattaaagcaacggttgttacccgttgccgccatggagattaccgcaaccacaattgtggttgcggatgtcttgacggcgaagtcatttcgccgaggacatcgacttggctggttgttattagcctttgtacaaccatttggaccgtggctctattttgcgtttggacaggaacgttagggtaattagtaaattaaagtggggttaagttcgggtgaaagctcggacttttttacgttgatgggcgttttttgcacgtttatgaatgtttttttgaatgcaatcataagcgtgtataataaaagtgtatataaagatacctataatttgaaattattatggtaatccgaatcatatagagggggactttattaatgcagcgagaatcagaattacgacaacaagctcaagaggctattaagggactaatcgtccggttaagtgggtggtctgatcagtcgggggacttattggatattattgatgtattaatgcaggttgataaaaaaatcactacggctaagaacccagaagccttagtcaatcgcctagtaaactatattcgtagtgtagccattaagggacggttacactttccagatgaagaagaaaagctaatgatcgacttaggaataatcgggcaaaaggccggattgaacggggcctatatggctgatttctctgacaagtcacagttctatggcatgctggaagaagtcccacaacattaataccggccagggggttgagggttaccggtcgtgtaattgctgattggtattccgaaagcgtcctccgattgtgatgctgattaaagcgtaagtaaaatcagcttgtcgtataaattaaaaggaacacttcaggctgtgatagtccgcttaaggttgacagggactaatacaggaaaactgaaagtgttccttttgttttaggataaccagcgcgctaaatagccggttgccattgaactggttctattcactgtgcgtcaatttcaatcgctttaaatcagctgttttagttacattgagtagtttctggcagtctgggcataatccatagacttccatattgtgacccgtaaccaagtacccagagagttccgccgccttggcttcgacactgcggaggtcgggttcgaaaacgtcagtaattttaccacaattctcacaaacgacgtgataatgtggtcgaccgaaaaagtcatagtgggtgccagcatcgccattttgtaattcaattacgattcctaagtcgacaaaaagttttaacgtattgtaaaccgttgccaagctcaggttaggtaattgagttgctaattcctgatagatggtttcgacggatggatgattatggtgagtaatcaaataattaagaatgatttgccgttgcggcgttacacggattttatggtcctttaattgctgcaaggcttgggtcaacatatcttctgccacgacgcggttcctccttttatcatattcacccttattaaaccacactttttagaaggattccaatttagaaacattactagatgaaacttttgacaaaattaattaacgaaatagctgaaaaggctttactggggctgaggacgtgagtaaactaacgataattaagtgcatgtggatagaggtggtaaaatgacgcaattaattgtaccagcattaccggttgagcgggtccaatacgaacgcgcatatgtacttggccttgaagcaatgatgaaagttatccggcaacttacgactacggaaaaaggacggcaggtacccactaatcagttcccagtatttgcggcgagctatgatgttccccaagcgttggcacaagttgcagtcctaaaagccgctactactcggttgaaggttcgaccgattcagttgaccgtgacccggcagtgcgtgacgttacgattccaattacaagcatccgctggacaaccagtctgggtgccgtccgccggggcactatggcgcctatatgatggctttttaagtaatttagttgggagccctttccagcacctagcaaatattcagattggcttacagcgcgttactggaccgctgacagtgactacgccaatacgccctagttttcaaaattatgatgttcgactgaccccaagtgggcaaactggttgcctagtgaaaattcacaaagcaccagaaatattggcacgacgggcaccgatataccagttaagtcattactcggaaacgattcggccggatgactagtcgtcattagctggatgattctaaataatccataatcacactgatagccagattaacggcggccataaaaaatcccaagctcatttagcttgggattttttgtggccggtatttaaggcctatcaattgacttaattatgcttggtggcgcaacgtcacattatcagttgtggctacttgagcatctgcttgtgcccacactagcagttgagcttgaatgttttccaggattttcatggataactggtagtcacgttcggacccggtgctattgaagctcaatgtacaggttccggcaaacgtgctggcggcaatttccataacgggtgagcactggaaggcacccgagaagacgcaattgacgaccgtcaagtcatgaaatttaagccgttcctggtcgacgacaccaaagttggtataccggagcgcaggctgtggtaaccagcgtttggtcattttacgcatgaccgtaattggcattgtatggttcattttctgtaaattgctaagtcgataaaggaaggcgacccgcgtacgctcgaccgttaacaagtcgtggacttgattgacgagctcactaaaaggtgcatcaatatctaccttgattgtcagaaaaacattgacggttaaattagcgacttgggtgacgttcgcatcttcagtcgtgaagcggcgcaggtcgattgggcacggcaatgtcacggttgtatgaccagttaaaacttggagtgctttagcgtatgccgccaaaatggcctcgctaataccgacgtcttgggccttagccactcgtcggacgcgcatgaattgcgtgctactgagcattacgtgaccaccgtgccgcaagttaattcccggataatggggtagtttaaccataccggtaacaatgggtgcatgaccgtgtggccgtgcaaattgacgttgcaacttagtgataactgggcgtagtcgccgttcattatgcaaattcgtgagatcggcataattgtaggcttgtgcgagcaggtacagatattctttaaacccacgattgtccgttagtaggtggctcataaaggcttgtaagacatcgtagtcaccgtgatgaatgacaaataaccgtagttgcggactattcgtaaaatcaaaatcagtgttttcaggactatacgggctttgaacttcctgaataacttggttgactggttgatcagtaacaacgaaacgattacggtcagcttgataatgaccgaaaatctcgggtacgatttgtgcggaagcgagcacggcagcctttaagcgttccacgtcgatctgactggaaaaaacgattcgcgaacgcattaatggcgcggcacctgtagtatgtagcatattcaaaaagtcaagtgcttcaccacgataatacacgattaaccccccaatcaatttctctaatcaatagtatagcagactctattcatcacactaacaatggacgtttggttttgaaaaaagttaagaaacatttgtgaaagtttattaatcctgtgatggcgataaagcactgcctcgattattatgtctggtagttatttcgatgagcaagcaataatcaggcccgctaatgaatgtctcacctcgtttaaaattagacttaagataatggcagttacgcggatggggactggaattgctaaactgactgaatattcagcagttaagattaaaattttgatgaaagcggctggttttttgtaaccggttccgactatttgccaaaaaaggggtatactaaaagtaattacaacttaaaggagtttttcacacgatgaagattatcgcactcgtcggtagcattcgacgttcctcatataatcgtaagttagcaacgtttgttcagaaacggtatgccgatcaactggatgtcacgattcctaacttgggcgcgttgcctttttatgatcaggatatcgagctagaagcccccgcggaggtgcaagcctttaagcagacggtcatggacgcggatggcgtcatttttgtgacaccggaatataaccatagtgttccaggtgtcttggaaaatgcgattgattggctatcgcgtgttgaacgaccgttaattgggaaaccagctatgattttaggggccacaatgggacccttagggacagtgcgagcgcagagtcatttacggcaagttttagattcacccggagttgggatgcagattctgcctggaaatgaattcttgttgagcgcggtgcaggacaagatgaatgccgatggggaccttacggacaataaggtcgttgagtggttagaccattgtgtggctgactaccttaagtttgctcaccagttagccgcaaacgactaattcggataaaataattgataaggggaagtttcagatgaacaaagaacgtaagttgatttatgttattttgaatgacgaagatgtggaatatgatcttgaagaattaccagatcaatatgtggtctatattcgccaacaagccggggattcacgcgacttgtcgttagttaatactgagattcagaacctgtttaaggatgccgaattggactttgaagaaaagatcaagcctgaaaatcggaaggctgacattgtgctagctgttaagcgcagtacggtggcagatgactaataaacaaacgtaaacaatagttgtagcggattggtgttttgccgttacgactatttttttgtaagatcaaattattggtctcaacattaaccaattcatgtgaggagggctaacaatgaccattgagacactgtatcagcagatgttagctgccatggggccccggcactggctccaagccggaataccacctgccgagacgccttgggagattctctggggcggtattctcgttcagaataccaactggcgcaacgtggattacgcactggctaatttaaaagcagccactgactttgagcctcggcggttactagcattgactgatactgaactgacgactttagtcaaacccgcgggcttctatacgcgcaaagttccaactttaaaagctttagcagcgtggtgtggacagtatgattttgacttgaccgtgatgcgagccttgccagcagaacaattgcggcgtgaactaatcgctctgcgcggtattggcgatgaaacggctgactactttagcatgtacgtttttcatcagccaacgatcattattgacacgtatttgcggcgcctattcggctggcttaaccaaccgttaccgagcaactacttaaaggcccaacaactgattatgcaggcgtggcattatgatttaacgacggcttgggagtggcacgcactgattgttgatttcggtaaacaggtcaaaacgacggctgatttcgaacggtcctttcttgcaacgcaacgattaacacttgcttcacaaagtttggcaaactaattaaataagttcctaaattcaagtgaaccgccttattttaatcgggttttattgaccgacttaataggggcggctattattatgtttataaaagaaaacgcttttatggttaaggacgttacttgattagttaggagggcctgacagttggtcactggatggattggcaattattagtgattttataacaaccagtgtccgaaattagtttgttaacaacgcgattattgattagtcaaagggggagaatcgctatgaagcaagtgcatttattaacgccggttgcaggacagttagtgccactcgaatcggttcacgatccggtgttttcacaagggatgatggggcaaggatttggtattgaaccgacagatggacaggtcgttgcaccaatcagtggtaaagtaacgatggttgcagcgagtctgcacgcgattggctttacggggaacaatggtctggaagtgttggttcatcttggtatcgatacggtcgaactagcagatcggccaccgtttaaagttaacgtgcaagttggtgatacggtcgaggccggcgaaaaagtggccgtgatggatttagcggcgattactagtgcgaacaaggataccacggtaatcatggccgtaacgaatacggcggatatggttaccaaactaacgcccgaactgggtgaagtccgtgccggggtcgtcggtgctgttgttgaattgaaagaacacgttgccgaagcatcggtggttaagggtaagggcggcaagtacgatgaattggcgactcaaatcattgctcaagttggtggaccggtaaatgtgaaaagcgtgattcactgcattacccgggttcgattttacttaaaggacgaagggcaggccaatgacgaggtaatccgaaacctaaagggcgttatcgatgttgcaaaggcaggtggtcagtaccaggtggtgattgggccagcggtgaccgacgtgtatgatgcaatcgtgggtcaactaggcgcaggctttggggatgctgacgcttcggctgttgcgatggagaaggaagcgaaccgggtagcgtggcagaaaatgacgccgtggcagaaggtcaaacacggttttagcagcttgattggtattattacgggatccatgattccagtgattgggttgttggcagcttctgggatcttaaaggggattttgtcgttactaaagaacttcaacctcgtctctgcgacaacgccgacctacgtgattattaatgcgatgggtgattccgtcttctacttcttaccgatatttgttggtttcaccgcagccaagaagttaggggctgatccggttatcatgggaattattggtggggtcttaacatacccagcaattgttagtatggcaacaaccggaaaggttacgggtcacttattgggaatggcaatcaatgcgaacttctttggcattccggttcacgttgcctcctatacctactcgattttcccgatgattgcgggggcgtggttagcaagtaagttggaaccatggctcaagcgggtcatcccaacagtcttacggatgatcttcgtaccgttgtttgaagttgtgattatttctggagccatcattatcatcctcgggccaatcattacagctttgtctggcgcattggctgcaggaattgtggcgatttacaaactcagtccagccatctctggcttaattatcggtggcttctaccaagtattagttatcttcgggttacactgggcgattattccaattgttgtcaacgatattacgacaactgggcacagttacttgaatgccattgtttctgcaacgatggttgcccaaggtggcgcggtcttagcaattgcgctgaagtctaagtttgctaatattaaagagctcgcttggccagcaacgatctcagccttctgtggggtcactgaacctgcaatgtacgggatcaatctgaaatacggccgggcatttattactgcaagtatcggtggtgctgtcggcggtttcttgaccggactgtttaacgttaacatgtggggcttcgccggatcattgatcggtgtgacctccttcatcaatcctaaggggcttgattttagtttctacggtttcttgattgcctctgctatcgacttgattgtcgcctttacgttaacgtggatgtttggcttttccgataatgatgtcaaaaacgttaagaaggcgcctgaaaagaagcaccttggtcaacaggttgcaaattagggcttaactatttttagaaaagcatttcttagggctgctcttgtaatgagggtagccctttctgtgtatttaattttaacgatgtagcgacgaaatgtttccgaattaatggcggcaatgggtgacgttaatatcataagcggccgctttatttgacaaatatatcgatatttagttaaatgtaactaataaagttacatgaaagggcgagttaaattgaaatatgcgattacaggtgccactggtcatttaggacaacagattgttgccgcgatgagaccgttagtcgccaccactgaattatatttaggggtccatacactcagtaaggcccaggtataccaacaacaaggtttgcatgttgcggctattgattaccagcagccagagcagttacgcgcatttttccaagacagtgatgtcctgatctatattcctagtaagagtcatgatagttattcgcgggtccaagaatttgagaacgtcttagcagcagtccaacaggcgaatgtgcatcatttcctagtcatgggtttcattgccgatcaggtgaataatccatttgaattatcagcattttatggttacgtgccccggcgattagctggaagtgatattaactatacgattgtccggaatgcgctttacgcggatccgttagtgccatatttgccagaattaattgaacggcacaacgtcgtttatccaatggctgatcaggctctcagcttcatcagtcaggcagatagtgcggccgcttttgctaaagtcgccacaacgcctgatttattacaacgtggtcgaatctatacgttaacacagtcccgagcttacacgatgccggaactcgctactgtgcttagtcaggtgagcgggcaaccaatcgggtatcgaccagtgtccttgcaagccttcagcgatatgtacaatcagaatggtgaggggccaatgttggcctcgatgtatgccggtggcgcccgcggactattagccacagtaagtgatgattatcagctgattatggatcgtcccgcccagtcattgctggattacttacaaacaaattatcagaaaagttaattaatcacggaaaattccaagcgagttaatggtcgcgacgaaattccatgctataatttatatcaatagcaactttggaaaggagtcgccagtatgactaacgggacgcgtgcagatttacgtgagctttttcataaaggacaattaactattggcattagtgaactaagcagaatgactggtgtctcgccacgacaactacggtattggcaaaaaaaggggtacattattcctaagaacgaggatgagccgggccaggctcgcgtgtatacaatgaaaatggttatcaaggcagccgcgatgagtaatttattgcagactggttataccttgaaggcggcggccgctcaggtggatgagcggatgcgaccagcccaaacaatctatcatctgcttgccgatcgttaccaaggatatgaagtggcggataatggtcagattcttgtcgacttggggccatttgatcctcagcctgaccaggaactatttgtcaaactcgtgggggataaagttaagtttgaattgaaggataaacaagagtaattgatatgcaggtctggggatccccagacctttttgtgataaacagtcattttgtgaaagcaggtaaatcaatgatcaaattaatcgtaagtgatatcgacggtaccctagtcgacagtcagggacagttattaccggctacaattacgggagttcaagcagcggttgcacggggggcacaaatggtgttggcctcagcacgttcgcctaaggggatgtttggaattgcgcaacaactaggaattaattcgaccatgattgcctataatggcgcgctaacggctacgactgatgtgaatgatcgactaactgtttttgaagagcaagccgttgaccctaaactagcacaagctgtgcaaacggtagtagctcatgattggccagctgcctcaattagtatttattcgaataataactggttggtggctactaatggcccgtgggaacagcaggaagcgacgggaattggttatgcaccccatgtcacggatttgggcacatggttgcaacggatgccgacgccagtgcataaaatgatgatcatggccgatccagatattattcaggcgattgaacaacgattaagccgtgatgaatttagcggcttagcagtttatcgttcgaaagaaacttatttagaaatcgttgcggcaggcgtaactaaagcagccgcattaatgaaattattacaggatgatcaagttacccctgctgaaacgattgcgtttggcgataactttaatgatgttgcgatgctccagacagcggggattggtgttgcgatggctaatgcgccacaacccgttaaagaggcagcgaacatagtaacaactgataataatcataatggtattcagctaaccttagctcagtattttgctgatgttacgcgctaattaaaaggccatttacgaatcattaaaaaataggaagcccaacgccatgttcgttgaacttcctattttcgtattgtagaagatatttaagagaaacttacagctagctcgttattagcgcgctaagatttctttaatagctacactggcttccaatggttgacgtcccaagacatgagctaagtcggctgacttttcagccagcgcaccatcattgattggggattggaatgaggcaaacaaagcagcggtatcatgatttagaccagtcgtttcaaggaattgcacgtacgcatcctgactgacttgggtaatcttaacttggttgccagttgcttcttggagtgcttgaccgagtgcggcataagtgaggggtgtcccagcaaattcgtacacttcttgaggggcatctgccatcaaaacggttgctgccgcttcggcatattcacgttccaaggcccagccagctgtattattagcccagtacaaggtttcttggttatgggcaccactttgtaagaagcccatttcgttttctaaataccagttgttacgaagaaaactgtgcgcaatatcagtcgcttttatggcattttcggtggcccgatgatcattggctaaggcgctgactgctgcctgtgcgttgggaaaactagtgtaggcgacaaatttaacatgagcggcgttaagggcagtcacgacgtttttatgagcggtggcccggtcaacgggaccaccaggttgtgatgaaacgaagagcacgcgttcaacgttctcgaaggctttcgtcattgagtcgacatcatcgtaattcccggtacgaattggattatcaggaaacagctgagcagctttgtcctgattacgagcaattactaaaacattttctgcaccaactttagcattcagcgtactaacggcgctttgaccaaatttaccagtagcggcagtgatggcgtatttcataattaaaacatcctttcaaattgctgtagcaataaaaattacagtgattagcttatcacatgtaacttcaaagtcaacaagtttgcttccaataaccgaaaagacaattttcgtatgctgacatttaatgaatggctaagaaaaataaaaacgagtattagtgcgaatttctgtgactaatgaagtttcaccgctattgatttatgtccgaaaaaataggattagacaacttggtgttatctaatcctaatttataaaagtcagcgataaatggtggcgtttacttattattcaacgacgtcaaaattcgctgtgatgcctgtccgttgaagtcattggtttgtagccgttcaaaaacgtctttcataatgtgcattaattgttgatcggacaaaccttgggcagataatgtattgagcatgacttgcagcaagtcgattggcaggaccggtcgctgttcaggatgcgcactgaagaattcctgaacggcttggtcgtgtaagcgccagtaaactgggttttggacatcatcaaaaatcgtttttagttgctctaaggccggtgatagcggaatgtttttggcaataatcgtcgttagcatcccatcacgagccgggatacgaacatccgccacgtaatcttttaatagtaagaaatgagtcttgaatggtggccgtaacgtaaaggtcatcgttaatgcaatttgactatcagtagctgccatgatgattccccctaatatgattggcagtgagtggcaaattaatgacgcttcgtgaagcggacgacggcttcgcaacgagctgtttgtgggaacatgtcgatcgattgaatatagtcgacttgatatccgcgggtaagtgcttgtaaatcctgagcaagcgtcgatgggttgcatgaaatgtagacgagtttttccggtgcgctttgtaagatggcatcaattaagacgttatctaaaccagtacggggtggatcaacgaccattgcatcaggcgcaaaaccgctcgctaaccattgcggtaacaagacttccgcctcaccaacttcataatgagcattagtgatttgattgcgttgggcgttggcattggcatctgcaacggctgctggaatggtatccattccccgaacttccttagccacgtcggctagtgataaaccaatcgttccgacacccgaataagcgtcgaccaacgtctcgttaggcgctaagttcaaagcttcgcgtgctaagcgatagagtttcttggtttgctgcgggttcaattggaagaaggcccgagcagataaatcgaagactaggccgtctagctcctccgtaatagttggtttgccggctagtaatgttgtttggtcaccccagatcaatgaagttttaccagcattgatattttgcatgaccgacacgaccattggcagtttttcagcgattttcatcaataattgatgctttttcggtaacttgggtgtatttgtgatgaagaccagctgaatttcaccagtggcggccgcttcacgcacaacgattgtcttgacgatgccagaattatgttcttcatcgtaaatcggtacttggagttcctccagccaagccacgacttgacgcatgactgtcattgtcgccggcatttgcaccgaacaggtcggtaagtcgactaggtcatgactattttctttatataagccagcagcgacgtgcccatcaattaaacgaacttgaaattgggctttgttgcggtattcataaggattagtcatcccaatggtgggccgaacatcatagtgtcgataaccagctgggcggtatttttcgagtgcttgacgaattaaatcttgcttaaaggctaattgggccgggtagtcgaggtgttctaattcaaaaccaccgacttcgcccgcataggcatcgcggggatcgacccggtcaggactaggcttgcgaatactacgaatcttagcttctaggtaacgtgggtgcacggcggttacttcagcaacaacgacttcttcaggaagggcgcccttgacgaaggtgatgacgtgtttgtaatagccaataccttcaccgttaatgcctaaacgccgaatggtcagtggaaaacgctggccgatgttaacggtcgcttgcactttttcatccggctgttgtcggcgccgatcattgtgcgatcgggattggtgcgaataatgattagattgtggcataagtttgattttgacctcgtttttctgtgaactgtgttaacctccattatagcatgtggaaagacacaggataactgaggaggattgtttgaaagtcgcctaacagtcaggttataatgattctaaattagtaatcgggggtgggcatatgaattcattgattagtttagaaaaagttaattatcaaatcgctgatcaacatattttacatgatgttgattggcagattccaactggggctcatattacattgacgggaccatccggtggtgggaaaagtacgttattacggatcattgcggccatgatttctaaaacaagtgggaccttgatttttgatgggcagccgattgaaagctatgacccaatcatgtatcggcggcaagtctcatattgtttccaacaaccgacgttatttggtgagacggtggcagataacttagctttcccgtaccaaattcgtaagcaagtcatggatacgcaacgagtggtaacggcgttaaataatgttgggctgtccgaacgaaccctgcatcagccgattaccgagctttccggtggtgaacggcagcgggtcgcgctgattcgcaacatcttattcttgccaaaagtgttgttattagatgaagtgacagctggtttggatgaaaataataagcaaatcgtgcacgcctggttacgacagttaaatgagcaggatcacgtgacaacgatcatgattactcatgacgcgacagagattgctgcggcagatcaattagcgaaagtggttgctggcagattggaggtacacgcatgaatttagcagttaataatacgtcgctatttttggcggcaatgttagtgctcgtcgcgttaggaattagtttgtggcagaaacttggcttggataaggacatcgtcattggtgtcgtgcgggctgttgtacaactatttatcgtgggttacttgctaaagtatattttccgagtcaataatttgtggctaacgctggcgatgataggcttcattatcttcaatgcggcttggaatgcgaaaaaacgggggccggggattgaccatgcattagctatttcgttattagccatttttgttagtacgggggtaacactcggcgttctcgtcctatctggtgcgattaagtttgtgccatcgcaaatgattcccatttctggtatgattgcgtcgaattcaatggtcgcaattgggctggcttatcgcagcctcaatagtcagtttcatgaccagcggcaaggggtgcttgaacggttggcgttaggggctggtctactcgatgcttcgattgccatcgtgcgtgaggcgattcgtacagggatgtcaccaaccattgattcggcaaagactgtgggtctagtcagtctgccagggatgatgtccggtttgatctttgcaggggtcgatccagtacgggccattaagtatcaaattatggtcacgttcatgctcttatcagcgactagtttggggtcaatcattgcgtgctatttagcttaccgtaatttctataatgaacaaaaacagttgaagtaatgactcctgattgcagtcccgcggggagtcctttatgatggaagctgaaataaaacttaatgcgggggtattgatgtgaatgacgcagcggtttgggttccagttccagtaatgttttactggggctggttagtaccactcatatttggaaccatttttggttggcgttatcatcgcgataaggttcgcctaggtaacggtatttggttttcgctatttttctattcgtttttaaccatgctggcaattacaattttaggtagcaatattcactggttgatcattatcagtgggacgttgtttgtgttgctgatcctgttgattggactgatttttaccttacaagctttcttgctcttatggaatgcgtggatcatgtggcgtcatgagagtcatacgttggcgaatatgctgaccttgtacttgggactggccattctgattttgccatttttaggcaatctgttgagtagtcatgtgccgcagcccgtgagttattttttgacggtatttccgaatctggtcattttttaccttggtttttggttttataactatctgacaatgctgacgatttatcaattcaattggccccgtctgcgacaagattatattattgtgcttggggctggcttgttagatggagaccgtgtctcgccattgctagggcaacgaatcatgcgtggactgcgcttttatcagaagcaacaacgcaagacgcatcatcgggccgtgatgattttctcaggtggtcagggtggtgatgaaacggttccggaaggccaagccatgctggaatacgccattgcgcatggccttcctgcaacggatggctgggcggagacgcaatcgaagacgaccttgcaaaatatgcagtttagtaagcaattgattgcacagggccctgttaaaaatccacgcacgatttttgttacaaataattaccatacctttagagccgggatgtttgccaagcaagcaggtctaaaagcggatggtattggtgcgcggacggcgcgattcttcttaccggatgcgatcattcgtgagtatattgcgatatttgtccgaaataaatggtggcacgcggtggcgatgcttggtatcttgattgtgtcgctattattgacgtggtttgatgtctatcaagcatcgttatagcgattactaaggctgaatcagtaattaaaatattccaagtcaggtgtacactggcttggaatatttttttggctggaatgttaaaaatgaagttatcgaaatggcaggatacttccatttttttactggtggactaaatgttttaagggcaaacgttttagtgaattcattttgaaaaaccaatttgtcttgacaattacttgaaaggtcgttatattaattatggaaacgattccaaatagggggtgagcttaaatgacaacgattagtgaaatagcagctgaggctggtgtaggtgttgggactgtttcacggtatttaaaccatcggcctagtgtttcagttgctaagaagaagcaaattcaggcagcgattgaaaaactggattacaccccgaatgccattgcgagtcagctacgcgcgcagagcactaatacgattggtgtactggtatcaagaatctctaaccccttctttgcacagttatttgatgcattggaacgggagttaaacggatacgggtttcaagtgatggtaatgcagactcatgatgatgcgttggcagaacaacactttctggataaactcaagcagcaacaagtggatggcgtcattctggcatccattgaaaatcaacaactagtggcacaattgtcggcgacatatgctaatcagatggtgctgttgaatgaagaagctactgatattggtattccaatgatcagtttaaatcattatcaggcaactaaagatgctttggcatacttatatcatcaaggtcatcggcgaattgcctatgccacgggtggtgattttcccagtacgcatcatggacgttcgcggacgcaagcctatttagatttttgtgaagagcagcagttagttgtaaacaatagctgggttttcgcacaacaacatacgattgcggatggacaagcgttggggaagcaattagcgtccttaaaccctagtgatcgcccgacagcggtgtttacaaattctgatgaggtggccgttggggtaattgatgagttacagcaacaacattttcgcgtgccagatgatatggccgtgataggatatgacgatcaaccatttgcggcggtggcccaagttccattaacaacggttcgacaaccggtcgcggcaatggctcaattggcggtcgatcagctattacatcacttgggccggttacaacgacctgagttagcgattgatctaagcttagacttaatcaaaagaaaaagtgcttaagcctttttcttttgattaaagtggaatcgattccaaatataggagtagtaattatgcaaaaaaattggtggcaaaaagaagttttttatcaaatttatccggcatcatttaaagatgctaataacgatggcattggggatttgcgtggaatcatccaaatgttaccccggttgaaacagctgggaattacgactatctggttatctccaatatatcaatcacccatggttgataacggttacgatatttctgattaccaagctattgattctcggtttggaacgatggctgattttgatgagttgatggaagtaactaaacgattaggattaaaaatcattttagatttggttatcaatcatacctctgatcagcacgtgtggttccaatctgcaattaaatcgccgacgagtccgtatcgtgatttttatattattaggcgtggggcacacggcaatccgcctaataattggcgatcaaactttggtaaaggctcgtcatggacgttattgccaggaagtcaggatgagtattatcaccatgtcttttctaaacaacaaccggacctaaattgggaaaatccggctctaaggaaacgaatctatcaaatgattaattggtggttggcaaaaggggttgcgggttttcggatcgatgcaataacattcataaaaaaagatcaagattttgccagcattagtcctgatggtgttgatgggttaggtaaagtcaaacgtaaagctgaaaatcgacctggtattgaaaagttcttagctgaattgaacacggctacttttaaaccagctaacgcggtgacggttggagaggcttcgggggttagttatgaccaacttggacaatttattggtaaaaaaggttacttctcgatgatttttgactttcattacgcagatattgatattgcatccggatcagagtggtatcgacgagttaagtggacaccgacggacttacggcgcgcaatttttaaaagccaactggcgattcaaaatgtcggctggggagctaacttttttgaaaatcacgatcagccgcggagtattgataaatatattcagacaccagcttatcggaatgaaattggtgccaaagcactagccttactttattttaacttgcgcggttgtccatttatttatcaaggacaagagctgggggtgacaaatgcacggcgtgactcaattaccatgtttaacgacttgagcagtcacgataactatgatcgtgctattgaagagggatattcagcaagcgaggcgcttgcctttgtaaatgctcgttcccgggataatgcgcgattaccatatccatgggatgattccgtcaatcaaggctttaatcagggtgccaagccatggattacaccaaaacagtcacatgatagggtaaactggcaaagcgaacaattagattcaaattcagtttggcatttttatcagtcattgattaagttacggcaaatatcaaatttaagtcaggatttaatagtcggtgattttaggccaattacttgtgattgtgaccaagtgattgcttatcaacgtggtcgaagggtacaggtgtatgttaacttaagcgcaaaacggttattcctaacgttacctaatggccgacctcgattaaataattacgcacattatcgactcaatacgttggaaccatatcaagccattctttttgaggtgaattcaaatgagtaaaaactatcaggtacttgcgaaaaaaattattgatattgttggtgttgacaatgttgaatcggttactcattgtcagacacggttgcggtttgttgttaaagatcctaagcagattgataaagcagcacttgaagacttagatgaggttaagggagtctttttcggttcaggacagtatcaggtcattattggcactggtgttgttaacgatgtgtatgacgcaattgaaaagttacatttagttaatgcaatttatagtcaggaaacaacgactacgccgactcctgatgatcagaagtcaccattgcaacgattcatggcaatgctttcgggaatctttattccaattattccggtgattgcagctactggacttttcttgggattacaaagtgctttgactaacaatcaggttttacagttgtttggaacttcatctgccgcgattccggcaagtcttaatacagtaatttcagttttaacggggactgttttttcatttctgccagctttaattgtttggtccacatttcgctattttaaaggtacaccaattgtcggtattgtgattggactcatgcttgtttccccttcactgcctaacgcgtattcagttgcgggtggtacagcgaaagcgattatgctttttgacaggattccagttatcggtagtcaaggatccgtattaacagcgttagttgctggttttcttggaagtaaactggagcattactttcataaacacgtccctaacgttctcgaccaaattttaacgccctttttaacgatgttagttacttttggtattatgattttaggggttggcccggttgtacactggattgaaaatgtgatgattagtggtgttgaagggttgattaacttaccatttggaattggtggttttttgattggagccgcttatccgttaatggtgctagttggtattcatcagatgatgattgccatcgaaacgtcactattagcagccaccaagctcaatccgttaattactttagaagccatgtatggctttgctaatctgggggtagctttggcgatgattttacgagcaaagtcacaaaaggctaaggctaattttattggcgcattttcctcgcaactatttggtgtttcagaaccaaccttgttcggggtcttgattcgctataatttcaagccgttggttgtaaccgttttaaccagtgggataggtgctggcgtactgagtgttatgagtgtggcagcaaattcatatggtctagccgttgttccctcttatctgatgtatatttacaatgctcgtgatttgctgatttatacggtcgtctcgttattgacggtagcagtggcttttattgccactaatatgtttgcgattcctaaggacatattaaaatctgatcaagtacaaccaaagattgtagatgatacgatattttcaccagtttctggtaaaagtattgccttgagtacggttaacgatccggtctttgcatctaagatgatgggggacggcattgcaattaagccacaggaacaggggccggtaaaagtctatgcgccacaaagtggtcagatgagtgttgtagccgatacaggacatgcctatgggttaacaaccaataatggagttgagttgttgattcacatcggtattgatacggtgtcattaaaagggcaaggctttaaagttatcgttaaaccggggcaaactgttcaaaagggtgatctcttaggtgagtttgacgcaacggtgttaaaagctgctaacttagatgacacggtcatggtgattgtgacaaatagtaaaaattatcaacggatagaatcagaacctaatcagtctattcagtcgggagcagcactgctggcgattcaagggcgtccggaaatgacgactgcaacagcatcctaaacgtaagtacgataaaaccgcgatttgccatgagcaagtcgcggttttattttgaaaatttgagtaagtgcagtactagcatggactagctagcactaaccgtaatatcaccattgctggtcgtcagtcggtattgtacggccgccgattggttgacctggtaatcaccgccatcggactggagatgattgaaaatatgcaagtccccatcgctagtgctagctttaacaccggttgtccgtggcgcggttattcgaatatcaccgtcactggctgtagcggataaactttcagtgatgcgattattattgagcataatatcaccttcgctacttgttagcttaagggctttgaactgattattggttagatggatgtcgctatcagcggttataatttttgaagcagtcttggtaaaatgactgtcggtgatgctgatatctggatcgctattgatttgtagactaggcgccgagacacgagttaaccgtaaattatcgccggtcaacgtcagcgactgattgactttgacatccgttaaattaatatcgctatccgtactaagacttttcaattggtcgacggtgacgttttgcaacgaaacgttaccactttgactagctttggcggttatttgatgaatagtagttcctttaggcaccgtaattattgtcgtgtcagcaaattgtccgacgttatcgaacatgaagcccacggttttggcgttgtgtgtcgttgaagtaacagtgacgtgaccattgttggtcgtaacagttggtaaggcgcgcgtggcggtaaccgtgatattagcagctgtgccttgcttaatagtaatattgttggccgttgcaatcgtgatatcttttagctgactgacgtggtagcgccgagtcttatggcgaacaatgtgaaaaccctggtcccaatagacgctttgaataccgttattggcaattccaaacatgattagaagcagtccaacaactaataaaataatgccaactctaattgtctttcgcatggtggtgacctcctcgttccgcccgatttttcttaacaaatcggtggtataggttttgtacgattttggcaattccttgcagaataacgctaataagccagataaatagtggtaaaactaatagctcggcaccaataatagcaagaccgctacctaggtagaatagtgcgacccatagcgactggccgaagataccgatgccggctgttagcatggcaaatgcgaggatggtcacgccaattaagatggcacccgctgcaatcacgaatgcaaagacggtaacggccaaggcaaagaagaccgctaaaatagctattaatgcgggaattgtgatcggtgttgataataaagcaagcacaattagccaaatcgtgcgtacggttgcttgagatttttgccgtttagaagtattggcattgagattttcgttaaaacgaatcgaataatcggctaacactttccgagccaattgtttaggcgttcccagttcggcaacgcagtcatcataattggcgattgccgcgtctagtaagtattcgcgataaaattcaacaacctcgtcgcgttcatcatcggtaagttgaacgagtaacgcgttaaatttggataagtagtcgttcatggttcatcctccccctgaagtaagtggttaatggccaaataataggtttgccactcttgttgaatcgcactcaattgtgtcaggccggcgctcgtaatctgataatagcgtcggttgcggccttgataggcctgatcgtaagtcgtgacccagtcatttttcttgagtcgtcgaagcactgggtagagcgtcgattcggacaccgagatggcggcttgcaagcgctgcgttagcgcgtaaccatagtaatcttggcctttaaggcaggctaaaacgcacccgtccaataactcggaactaatttgaatggccattgctatccctcctgctatattatacgtcgtatagtattgctcaatgagtagtatacagtgaagtgaaactaactgtcaaacttaaatattaaaataatgataaaaggtaaactacctttagccactagtaaacgcaaaatgtgcttgctaacggtgactgaaataggcccgtactaaagcttaaaatcatgatgctcagcgagtaccagctgtccggtacgcaagggtgatactatactgagctgataaggcctagaaaaatgactgatttcgatatataatcattatattgaaatattaatacagttaattgtcatggctgagttaattattatcgataatattatgacggagggcaattatggaaacggacatgaagaattgtgtggtttgtggtgaacgaattccccaaagtgcccagtattgtgaaaaatgcggcagtggacaaccgacagttgctgaggataagtgtaaagacgcggaaacgacgactttaaagcagccgcatcatcaaaaaaagagcttacggacgtggtggttttggttgccaccagttatctgtgcgctagtcattgtctttgagattggatttaatttgtatcaggctcgggaaactaatacgcttgcagccaatattcaatcagaaatcagaacgaataaagctgaatatggcaaggttaaagtgagttggaatggtggtgccatgcgtgtgcggatatcaaagcaagcgccagttattgaaagtgtcgatcaaggcaagaccgcttcgtggcagtcactagccaagacactgcaaagccgctctgaaaaaatcgcgaagaatcacaatcaaaaatattcacatattgaggttttgtcgcctaagaacaccaaatatatgtggttggaagtcaatcatggcaagatgaaattcaatattgcaaatcagttgaattagctgaccgggttcacgacataagcaatggtgtaaatggtcccggatggtttttagcaacacaatgagtgataaaagatggtcgctgaaagacgccgatacacacaaaaagcccggttttccgggctttttgtgactatcaactggacgttatcaaatagattgcgatggctattggtttgtgacgttaccaccaaagtatttattagacagtttctttaaggtgccatcttgacggagttcttgaatcgctttagacagttgtttttggagtgaggcgtgctttttagtgacaattgcgccaatcttttgtgttttgatttctgaaccaccactgatgaatttcaagctggcctttggattctgcttgaggtaagcatagaacgcttcccgtgagttgatcgttccggcgacgcgaccttggtttacgaggtcgatcgattgttgaaagccatcggtcggtgtgacggtcgcacctaaacgtttagcatcggtcgcgttattactagtcgttgtttgggcaactttcttgcctttgatatccgtgatcttgttaattgaggaccccttcttgaccgctaattcggatttagagtagatataaggcgtagagaagaggtatttttgtttacgttgcgcagtttcagcgatatcgttgatgaccacgtcgtatttgtcgacatccaggccagcaatcaaggagtcgaatttcgttgggacgaactttgccttgagaccgagctttttagcgacggctttaccaaggtcgacttcaaaaccagtcaacttaccgtctttgcgatagctataaggctggaaggtgccttctagcccgatcgtcaacgtgtcgctcttttgcaatttgagctgactacttgtgctagaagtgctgcttttagatgagctagaattaccgcatgccgtcaaggcgactgttagtgcgagtcctaaaattgttaaacttactgctttgagccattttttcatatcgattacccccgtagagctatatttttttgacaaaaaaagtcgtcctttatcgaaaaaggacgactgctgatcgtggtaccaccttagtttccaagcgcgtgcacaacgcttggctcaatgagctaattcactcagtacgctaacgggtacgacgcgttactggcttgctaatgctcaccaataccatttagagaccatcttcgtatcactgtccgaccgttttacaccaaccaacggctcgcttttcgtggcaatcacactactcatctcatcacaatgtttagatattgaggctagtctacaagattaaataacaattgtcaaatcgaaatcacattttatattaatctaaatgccatttgttgtgaatgcgccagatcgatggttgatgtgagacgctagggggtgctaaaaaacgtgcatctgactgggattttccagttagatgcacgttaactcaaatgaacgctattggtttgctttgtctgaaatcgtggtgaacgtcatcgcggctaagaagtcggcaattcgttgcgttggctgcttaaagaattcagcgggtgtcccgtcgaacagaattttgccatcttcaacaaataggatcttatccgcaactgcgcgggcaaattccatgttgtgagtgacgataatcatggagtcttcttcctgagcgagggctagtagaacgcggagcacaccagcttcgagttcggggtctagcgcactagttggctcatctaacaagatgaattcgggatccatcgctaacgagcgcgcaatcgcgacccgttgttgttgcccaccggataattgttcggggtaggcgtcggccttatcttgcaagccgacccgggccaacaattctagcgcggactttttagccgtcgcggaatccttttttaagacttgcacggggccttccatgacatttttaacaacgctgagatggggaaacagattataaccttgaaagaccatcccagttttgcgtcgaatattgagaattgttttattagtcaacggcttagtaaagtcgatagtttcgtcattgaagtggtataaaccttgttcgggccgttcaagcaaatttagtgaccgcagtaaggttgatttaccagaacccgaggggccaactatgacggtcgtctggtgttctttaaattcagtattgatatcggttaacgcctggtgattgccaaacgtcttatttaagtgttctaatttgatcattcgacaacctcctaattaagcggccgtaagtaacgtgacgtccgcttttccaagtagccttgtagccagctgagaatcgtacatagaattgcgtatagggcagcaaccagggagtacatcacaagtggttgataattttgagcagcaatttgttggctgacttcgaacatttcaataatcgtgattgaagcggccaaggaggtgtccttgactaagctaataaaactattggatagtggcggtagtgagactcgcgcagcttgcggcaaaataattcgtttgagtacttgtgacttggtcatgccaatcgagtaggccgcttcccactgaccttgaggaatggagagaatggctgctcgaatcgtttccgcacagtaagccccggtgttcagtgaaaaagtggcaatcccagcagtccaggggtcgagctggaccccatttggaaagagccctttgattttaaggtagggaagcccgaaatagacgataaagagttgtactagcagtggggtactccgaaagagccagacgtagaagttagcgatggcttttagaattaaaaaccaaccacgacgagtcgaaatcttgacgagggccgtgaaaatcgcaagtatcaaaccgagaataaacgaaataatggcaatcggaatggtatattttaaacccgctgcagcaatttgcggcgttgatgtgacaatgatgtgccagattgaatccatagggagcctcctgtaacaaattagaatttggtgctatgtatcccgccataatagcgggcaatggtacgttacttatcagtaacgttaccaccaaaatacttattggacaatttctttaacgtgccgtccttacgtaattcttggattgctttcgagatttgtttttgcatcttagggtgttgcttagtgacgatggccccgattttctgtgaggcaatgtgatcgccggaatcaatcagcttaatgttagccttcggattctgcttgaagtaagcatagaaggattcacgagaattaatagtcccagcgacgcggccttgtgagacgaggtcgatcgactgttggaaactatcggttggggtgatagttgcacctaaacgtttagcatccgttgcgttattgctagtcgttgtttcggcaactttcttacccttaatatcggtaatcttactaatcgatgagttcttcttgacggctaattgtgatttagaataaatgtaaggggtcgagaagagatacttcttctttcgggccgccgtttcggacatgttattcatgacaacgtcgaatttgtttgtgtctaaaccagctactaacgaatcgaacttcgttggtacaaatttagcttttagtcccatcttcttggcaacggctttcccgaggtcaacttcgaaaccagttaatttaccgtctttacggtagctatatggttgaaaagtgccttctaagccaatcgtcaacgtccccgatttttgcaatccgaggtcgttagactttgaactgctgctagtgttactaccacaggcggtcaatgtaactgctaaacctaacccaagcactgcaacgcctaattttttaacccatgacttcatgattcacactcctagaaatttttcacaacactcctagtttatccgaaaatgaagctgttaacaaaaaataagcattgagtgtcgcaaacggaccaatgcttatttcataatcggctagtatagcgttagtgtagcgaatcagagaaggactgtcaaacccttttttatcagtaaaagcgacgcaagcgcgggtgctcaaactgatacagtataaatggtcgtaaagcgtacggcttatttgatgtggatcctgatataaaaagtgctaatattcaggatcacgaccactcattacagctgacagatgtaatcaaaaaatgcgactaatcgcaattattacggttagtcgcatgatgagtgggtcaagttagaattggggtgcgaacgatgctgctggaacaattactggtgccggttgtaagatgtggccaaggcgtttaattcccagcgtaatcgtttcgacgtcgagactggtgaaattcaaccggaacccgtttttaaccttgcgacttgcgaattggcaagcggatggcacataggcaacgtgtgcttgcggtaaaacaacgtcattgagcaaggttttagcatcaattccttctggcaaggttacccagatgaagaagcccccattaggacgggtgtagtggacattttgcgggaagtatttatcgagtgcggctaacatcgcgtcacgtttaatccggtatgaagtactaatagttgcaacgtgatcgtcgatgtcgtgttgatctaggtagctgttgatagcagccagtgttacatttggcgattgaacatcgattgcggatttcagtccgaccaattcgtgcatgattgcgtcgtcagcaacaatccagcctgttcgcaaggccggggagagaatctttgagaaacttgagataaagatgacgcggccttcagcatcgtagtgtttgatagccggaatattttgaccactataacggaggtcccggtacgggctgtcttccaaaataatgacgtcgtactgattggcaagggcaacgagtgcttgacgacgtttggcactcatcgtcgtacccgttggattgtggaagtcaggaatcgtgtaaatcaatttgatctcaggatgagctttcaaggttttacgaagttgacgaatattcatcccattatcatcaactggaatttcgtagtaagtcggttcgtaagtgtcgaaggcggctaaagcccccatgtaagtcgggccttcgacgaccatggcatctccatggttcaacatgagcttcgccacgaggtcgatggcttgctgaccaccttgggtcatcatgacattgtcggcactaacttgaacgtcagcatgagtcgccattcgatctgcaattttttggcgtaatgccggcaacccttgagttgatgagtattggaaaatgccttgaccatcgtgttcaatagcatcacgataggcttgctttaagtcgttgtcagggaataagtgctgatctggaaaaccaccagcgaaggaaatgttttccgggtttgcactattcttgaagacctcatctaggtcggaagtgtcattgtttaacacgcgatttgcaaataattttttcataataattttcccccactcagttttttgtacttaaactgttttctttgattatcaatatgataaaataaagcttgtaattagtaaaactcaactttttcaataataagtgaaataaattcacctaagagaggtaaatcattatggcaaacttcgcatatgaagtcttttcaacggtcgttgcccaacacacattctatcaagcggccgctacgcttaacgttacgccaagtgcggtcagtcattcgatcaatcagttggaaaaagaactgggttttccactattcatccgtaaccgttcaggcgttgaacttactagtgatgggcggcaggttttaccctatgttcaagagattctgaatacggaaagtaacttgcgacaagttgccgataatattcaaggattgcactctggatcggtacggatcggcggtttcagtagtgtctgtatcaactggttaccccgaattattcgcgaatttaatcataaatatcctgatattaagatttcagtcatgcaaggtaactttaatgaaataaccaactgggccaagatcggtactatcgatattgggtttacgtcgatgccagtcaatgagaacttattagtgcattcactgatcaatgatccaatctattgtgtgacgcccgctgattttatcccagaaaatggtgaattcattacgactgatgacgttgcggataagaactttattctacaacaaagcgattatgaccgggacaccaagctagcactggaccactaccacgttactaataactttttacgattctcgattgatgatcaatctattatttcaatggtagaatccggtttaggcatgggcattttgcctcagctagcactacggaagctaactggagatgttaacacgttttcctttgccgaaccctataatcgtgagattgccttagttgccaacaaaacccaggcgaccgctccttcaacggctatcatgattcgtgccattaaacagtttttgaccaaggagtatccggatcagatgttatggcagtagcaaagttagggcagagcgttggcgtagccagcacgggcttcaatggcattgagcatgtttcgggaagccactcgaaaggcagatgaacgaccgcctaactggtgcaattagtcgttaaattattatttactactaagaactttgaacaaattattaatggggacatcaactgttttgaatacctcagtataaagatcatggaacagtcgtaattctactatcagactgacagttatatggcaagattgctgtcgctaaaatagccacggccaattcatcagaaacgggatacgcacatgtccgccattcgaccgatatcccgactggaaggcgttgtaagacgcgctcaaccaagctgggttggcactaacttaaacttttttcagcggacttaagttggctgcttttaacgttaaaggcttactacgaccagatcgcacaattaaagctaaaaatagccgcttttccagtagaccaagttggttgtcaggaaaggtggctattaatattttagatatgttttagataagcactctgagcaaaaatgacggctaggtcgattggactggttaaatcagtttataaacgtttgaatcgtattaccgatttgatggttgttgagtaagccggattgggtgcgccatgagtgcaacactttttgttgatagacctttaccactggcttgaagatagattgaccagccagggcactttgcagtggtaggggttggtcagctttgatggcttttccagcgacaatcaatacctgcatcttggaatcaatggtatggcggtgtgcaatcaatttagctagtgtggccgtttgcgacttggcggcaaccggcgtcgtttggcgacgattgttactttggcggctggtaccgttaaatggggtggccatcagtacaaggtgttgtggtgataagcttgttgttgtgtgttcgacatagttagtggcagtaagaccgccacgaccgtaactgacaaggttaaaccggcgaaatttaaactgctggcgggcgacggttaggagttgctttaataaatgcgtttgtcggtttgaatcaaggttcttgggcagttgcacttgtatgtaggggcggttgtcactgttgagcaattgtcctttaaatgtcacggtccccgtcgctgtaattttggcggtgaccagtgtctgagtggcactactgttctgaatatgggcagttaattgctgaatctgattgtgagttaagtggtcatctagtaagagcaccattggaatacgttcagtagaagtcactgttatggtggtgaccggttttgacttgtggacttgttgttgccaaagcatggtaccaccgatcattgctagcagaactactagccaggtagcgcctatcaatacttgttttgtcgttgctttcatatttcccgttactccatatctccaaataaactgcacttttaatgtaagccactcacagtcaacttgcaactgtttatacacacttttagatagcaaaagtcccgaccaagtaaatttggtcgggactccttaaaggtatcagtcatgtgctccgaatagggcagagactgatgctttaagattacatatggtactcaaaaagcatcaccccctttcattaattgtccgtagtttagtcccatttaatggtcaggtcaactaattagttcgcaaacggactaaacgcggtataatagaattccttggcaggggcactccgcggttgcggggtacttaacgactgaattttcagttgtcatcaagtcagttcatcattggtttattattcaaaatgggagctgatagaaaaagttcgattcaatgacgaatcgaacttttttgatcagaaagcatgaattacgtgtaaattttaatacgagaaaatagactggagttcttactggtttgattgattatgcaaccaagcgtgtgattgccaaaggatactaaccagtagaagtaaaaggccaattaacgaaattatagcgcccaatcgtaatccgggtgtatgatattgtaatttgactttatgctgaccagcgggaatttttgcaccaacgaaacctgtattaacaacttgagtcttagttggtttgtcatcaactgttaagtgccaaccagttgaatatggaatcgaggtagttaatacgctggcagtttgtgcttgagtgcgacccgtaatggtgttgttagttaccttttgttgtttaaggccgtgcttttgaatggccttgatttgacgctggtagcgccccttaaatccaactgccattaattttacatgatggatttttagttcaggcacttgactaaagcgaacggtcacgattcttcgtaaatgacttgaatagcctaaatttaaaataacacgttttcgaatcgaataattcgaaagattagttggtgattgttgtgaaaagttgttacttcgataagcggttgatgcggataaatagtaaccgctgagttgccaatcagtatgaagtgcctggcgaaactgttgaatcttagctaatgttgtattggggcgattagcaaatacggcattagccgcattattttgcaaaaattgattcaacgtaggtttgaccattgtcataccgctaacctctaaatataactctttattttgccacttttcaggatgatcaagaattaaatcataggtcaattgatgtccctgacaatcactaactaattgatgtagaccatctttgttagtggtttgattgtcattaacaatttttttattagtagtgactaatttctggcttagtcggcttgaagagttgactggcctgtcggtaacattcctaactttaacggtataggggacagtggtggccattttttgaggttgcacttgtttaacaccagttattggcttatcagtaatcggcgcttgtatcattgcttgctctttatcaacagcatttaatcgttgatatttggctgcgctaatctgagcgttttgcgtggatactaatggtaaaaagttgtcattaacaaaaacgatagttccggttttgttagataatccaccggccactggttgatctttaaatatacgcacgtgcccatcgttgttttttaaagcatgatagcctacgggaatatttttagggtcataacggtctgctagttcaaatatataacggacccccagaaggttgcgtgttgttgtccgaccatcagctgtgcttagtggtgaattaggatcggcctcttgattgccaattgactgtgaaaattggctaatacttctattctgtactgagaaataggatgcaatatcatgggtgccgagcaacattgagatgtttttctttccagaagcagctcctctagcatagaatccaggggttaatgtagttcgatagaaattatcattacgcggtaaagctttttgagcaccatccaaatatttattaatccaactcgtggcacttccacgatatagttgttgtggattggcaactccggaactggtcatagttgcaccaaagccagtattaattagattaagacatagcagagtgaaacagccaattatcagtgttaagcggcttaaatgcatcgcacttgacccgataaaccaggtgattaagacgaatagtaatatatatgatattaggtcgcgcgcactaacgttaaaagtaaaaccatttacgacccaaataattataattaagccaacactggcgcctagaaatagtcggtaatcccaactatcaagttttttccagtcatcgatgagtcgcattgtaagaacgctgaacagcaaagtgcttaataatagccaacgattggagggcgaagatagaacgttgaatgtggctgcaacagctggaagtaataggcctactaataaaataatgagtagactatttaagtcccatcgttgtttaaaatgacgtaacgaatgtaaaatagctaaccaagttaggctactgatacctaaaatgacccaaaacggcatcccatcactatttaaaaccaaattgggtagcgcaatataataacttaatgggtagagcgataatccgttggcaaattggccacctgtacgtgtcgagtgcaacatggcgaggacggtcggaataactaacactgctgcacacgctacaccgactaaaacagcgcttaataagtggtaaatcaattgccaaaatcgtgtatacgtttttgtttgacgatattgttgccaataacgccagattgtgtaaataacgctcccgagtgctaatacgtaagcaaagtaaacgttactggcaaccgtgattgcaattactattgccaggggccaccatgattttcctctgaatactcgctcaattccccaacataataatgggaaaaagatgaggggtaataagaagaagggatgatgcatgccgatgtgaagtgcaaaagcagtgaaggtatatgttaaagaaccaattaaaagacttaagcggctaaagtgccatatcctagcaaatgttaaaaaagctaggcccgtagcatataagcgaatcaaaatcagaaactgatatgcaaattcaattttagtagttggaaatagagcgactaagtagttgaatggatcgccgacaacgtaatacgcaaaagtcgtcatttgatcggctcctaggccaagattccaggaccatccaaataatgattgtgtgccaattcccttaagcattttttggaatgctgttagtattggcaaatgctgtgaaatcccatctactgtccaaatcaaagaccgtccgtccagaaatagtggactataaatgatgcaagttaaaataataaaggctactgtataagtaatccaaactggtactttccccaaatgacgcatgaaattctcctttgtatattggcataaagttttaaaaagattaactaaaaataattgaatgtaaccaacatagagatatagtcaatctcaatgattcccgggttgtaacaacaaaagtctattatctgccaagtaactggtgattttcaactgttatttaatgatttgaggtatttattaactgataatgatttattaaattggcccttgattgatacaatgactttgaattacgggtacttgcggtgagaaatataggtaaattgaatcatgatactttaattttacagattataatgtgtgggttttattattgctattagtttgtaacttaacgacttagagaatactcagatagattactaagttaataaattaattctagtcacaataagttaacggttaatcaagatgggcctaaattttcgatctctgattagcagaattactaaaatttagaatgaaattgggcagacataactaaaattctcacggttaccagcactatctggacggggcctttcaataaattggtacggcctaattaagaacttaagcttttctttaaaaagtgctaccgcaagtgcgtattaaatggtaaattaatagaagtagttttgtcatatttcttacattcatagggaagagggattattcacatggtctttaacttggtagttaatattattgggattgtggtttttatggccattgcctacttattctccaagcaaaagcacgccattaactggcgttcagttggtgtcatgttagtactagaagtcttattggcatggttcttaacgggttcacaagtcggtgtcgacgcggttaaagcagcggcagatggcttcacttggctcgtcaatgtatcatacgatgggatcgcctttgcgttagctagttgggttaacgttaagtcgatggacttcgtcactagttcattattaccaatcttgttgattgtgccattattcgatattttgacctatattggcgtattaccatggattatcaaatgggttggccggggcttagcttacattactggtcaaccaaagttcgaatcattcttcgttgttgaaatgatgttcttgggcaacacggaagctcttgctgtttcgcagttacaattgaagcagatgaaggcacaacgaaacttgacgattgcgatgatgtcaatgagttgtgtgacggcatcgatcttaggggcttacattaagatgatgcctggtcaattcattttgacggcggtgccaatgaacgtcttaaacgctgcgattattgctgcaatcttgaatccggtcgaagttaagccggaagaagataccattgcgaaaatctcaggtagtgcggctgttgaagaaactactgccaccactgaaacgagcggttctgaagaattagctaatgaacaagttaaggaagctaaaccagctcgcgaaccattcttctctttcttgggtgattcaatcttaggcgctggtcgcttgattttgattattgctgctaacgttattgctttcgtagcgttagccaaattaattgataagttgttaggtttaatcaatagcaatttatcacttgaaaacatctttggggttgtcatgttcccatttgcatggttacttggttttaacccaagtgatgctttccaaatggcttcatatatgggaacgaaattagtgactaacgaattcgttgtcatgggtgaagtttccagcaaagttaacgattttgcaccgcatttccgggcagtcttaacggtcttcttaacgtccttcgcgaacttctcaacgattgggatgattattggagctttcaagggaatcgttgatcgtgaaaagaacgatttgatttcacggaatgttggttacatgctattatctgggatcctggtctccttactatcagccggtgtcgttgggttgttcgtttggtagtcggtgatataatttaatcttgaattaaacgtaagagtgtcagctattcggctggcctcttttttattaatgaatcatcgggtcatacttttatccggtgtcgtttttaacggtgagatgttcaaggcagttcatgaatttgactagaaaaattgcaaactagaatagctgtcaatgatggctgtaaaagcagacttttcaagggttattgcgattttaacagcggggctgtgcattgattttaagtgttatttacgttaaagttatgaggtgacgtgaaacattgagttgtttcacaaaaagaggacgaatgtgacccctttaaggagagctattactaatgaatccagaagaatttaaacaagcgttagcccaacacgagattgcgctgacggcaaaacaattgtcacaatttgcgctgtattttcaactattggtcacgactaataagcagttcaacctgaccacgatcacagcggaaccagaagtttatcttaaacatttttacgattcactcacgccagcattctacgttcctgcgctgcgtgatcaaccgctcacgatttgtgatgttggcgctggagccggtttcccgtcgattccgctcaaaattgcgttcccacagttacaagtgacgatcgttgattcattgaataagcgaatcaattttttaaatgatctagtccaacaattaggcttaacgggtgtgaaaacgttccatgatcgcgctgaaacgtttgctggcaagaagtctgctcaccgggaaagctacgatatcgtgacggctcgggcagtagcgcgcctatcagtattgagcgaactctgcctaccactcgttaaaattggcggccagatgattgcattgaaagcagccaatgcccgtactgaaacggctgaagggacatacgccgttcaacaattagggggccaaattgctcaggacgaggcctttagtttgcccgtgactgctgatccgcgccatatcattgttattgataagaagaagccgtcaccgaagcggtatccacgcaagccggggacaccggcgaaacagccgttaacggcaccaatgtaaggtgggaggtaatttcaatggcattttcattatttggttctaatcgtgataaacataaaaccgaggcggccacgacccccacggagcaacaaattgtccgtattccggtcactgccattatccccaaccggtttcaaccccggcaagtcttcgatgaaactggtattgctgaattggctgctacgattgcggatcacggcttgttgcagccaattgtcttgcgggaatacgaaccgcagaaatacgaaattatcgctggtgagcggcggttccgcgccatttcttcacttcattgggcggatgtgccggccatcattcaaaagatggatgatggtgaaaccgcgtcaatggcgctgatcgagaatttacagcgacaagatttaacggccattgaagaggctcgggcctaccaagaactgatggaactcaaccaattgacgcaatcggcgctagcgaaagaattgggcaaaagtcagtcgttagttgcgaataagttgcgattgttgaagttagcacagccggttcaaacggcgttgttgcagcgacaaatcagcgaacggcacggccgcgcactactcaacttggctgtggagcaacaggctgcggttttgaaacgggtgcttgctgatcaattgacggtcaaagaaacagaacagctagtggcgaagacccaaacgccgccgaagcccaaacgcaaacgtgcacgggggttgaccggcgatacgcgaattgctgtgaatacgatcaaaaaatcaattaagatggtaactgatgccggcttacccgtgaagacccatgaagaggatacggatgacgggtatcggattacgattgaaattccaaaaaatcaaccaaggggtgatcaataattatgggaaccgtaattgcactcgctaaccaaaaaggtggcgttggcaagacaaccacgagtattaatctcggggctagtctggtcgaattaggccaaaaagttttattaattgacacggatgcgcaagggaatgcgaccagtggtttaggtgttcaaaagtcgaccatcgaacgtgaaatctatgacgttttaatcaatgacgttcccattaaagaaaccattatcccaacgagtcataaaggtttagatatcgttccggctacaattcagctttctggggcagaaatcgaactgacaccgatgatggcacgtgagacccgcttacgtgatgccatcgatgacgtgaaggatgattatgattatattttgatcgattgtccaccgtcgttaggcttgctgaccattaatgcgtttacggcttgtgattcgattttgattccggttcaaagcgagtactatgctttggaagggctgagtcagttattgaatacgatcaagctcgtacaaaaacattttaataaacagttgcgaattgaaggcgtgctattgactatgtacgatgcccgtaccaatctcggagcccaggtcaacgaagaagttcggaaatactttaaggacgccgtctataagacgattattccccgcaatgtgcggttatctgaagcacctagccacggcctatcgattgttgattatgatgcccgttcgaaaggtgcgcaagtctacttagctctagcaaaggaagtgttggccgctcatggcaagtaaagataaagataataaggcgctgggacgcggtattggagccctgtttgccgatgttaacgaaccagctagtgaagaagccgtggttgatctagatcttaaggatattcatgccaatccgtaccaaccccggcgaacttttgatcagacggcacttaaggagctcgccagctcgattgaaaagtccggcgttttccagccaatcattgtacgacaaccggatgccgagctgaataaatatgaaatcattgctggtgaacggcgttttcgggcgtcgaagctcgctcatcaaacgactattccagccattgtccgtgatgttaccgaagaacaaatgatggaaatagcggtgcttgaaaatctacaacgggaagatttaactccgcttgaagaagctgcggcctacgattcgttgatgaagaagctgaagttgacgcaggcggaagtctcaaagcgcctaggcaagagtcggccatatattgctaattatttgcggttattgggcttgccagatggggtcaaacagtatatccaaaagggccaactgtccatgggccaggctcgaacgcttttgtctttgaaggataaaaccaagttagcgccattagcgaagcgcgtcgtgaaggataacatgacggtccgtcagttggaacaaatcgtggcgcgttataacggcgagtccaaggagccggccaaaaaagttgcacccaagaagtcaccgtacatccgtgcgagtgaagaacaattacaagagaagtttgggacggccgtttcgattcaaactaaggcgaacaaagctgatcaagggaaaattgaaattccgtacttgtcaaatgaagatttgacacggattttagaaattctcagtattgatttaaattaattaatttataaaggggcgttgcgcatgtatgatttaggtgatattgtcgagatgaaaaaggcgcatccgtgtggtgtcaatcgctgggaaattacccggatgggcgctgacattaagattaaatgtacgggatgtggtcacgtggtcatgatgccgcgtcgtgagttcaataaaaaactcaaaaaggtattagaaagcaaagccgatcaagcttaattattaaaaaaggaagagtgaataaccgatatggcacttacagcaggtatcgttgggttaccaaacgttggtaaatccacattgtttaacgcaattacgaaggcgggcgccgaaatggccaactatccatttgcgacgattgaccccaacgttgggatggttgaagttcccgacaaacgactagaccgaattcaagaaatcatccccgcaaagaaggtcgttcccacgacttttgaatttacggatatcgccgggatcgtcaagggtgctagtaagggtgaaggacttgggaacaagttccttgaaaacatccgccaagttgacgcaattgtgcacgtggtccgggcctttgatgatgacaatatcacccatgtgacgggtaaagtcgatccgcaagatgatattgaaacaattaatctagaattgagtttagcggacttagaagctgttgataagcgtttggctaaagtgcaacgggctgctaaggggagcgataaagaagctaaggctgagctcgctgttttgcaaaagatcaaacctgccttggaagccggcaaacccgtgcgttcactagaattcaacgaagatgaccaacaaatcgtcaagggcttattcttattaacgtctaagccagtgctgtatgtagccaatattgccgaagatgacatggccgatccagaaaactctaagtatttccaagtggttgcggactatgctaagcaagaaggagcccaagccattggtgttgctgctgaaactgaagaagaaattgccgaactagatgatgacgacaaggccgactttttagcagctgaaggcgttgaagagcctggcttgaataagctgattcgggcttcttacaagctattaggactggaaaccttcttcacggctggtggtaaggaaacccgggcttggacgtttaaacgcggtactaaggcccctcaagcagcgggaattattcactctgattttgaacgtggatttattcgggctgaagtgatgtcttacgatgctttggatgaagccggttcagaagcaaaggtcaaggaaaatggtaagctgcgtttggaaggtaaggactatgtcatgcaagatggcgacatcgtcgaattccgattcaacgtttaagctgaaaggagcaattgtatagtgagtgagagcgaaacttcaaagacacctaggaacgccgcggccggggccaagcaggctcaagccgcagaacggccagttcacgaagcgactgagttgacgaagcgcaatgctgaatatatgcgtcagatgcgcaagtcacttgatgccacagcgttgagtggtgagaaaaagacggcagttctgaatgaaatgacgtctacattgttagcggaacaaggtcggggaaccacggctcgtcaattatacgggaccgttcaagaacggaccgaagagattgtgaatccaaaaaagacaccggtagaacgtcaaaaggcgaactattgggtcacggcgctggataatggcttgatgctattcatgattttctgcttaatgtatgggatcatgggcttcatcggcacgaacgctactaagaattcagctggtgccaacgggatcaccgctattctgattacgtccgctattggtggtttgggcgttgctaagttattcgaatacttaatgcctgctaaagatggcaagaaagtttcgttatggaagaaaatcgcgtggtcagtactggctatcatcgtttggatgttagtctttacaaccatgtcaatgattcaaggaccattgaacccggtcttaccaggaatcgcgtacttgatcattgccgtcgtcgtcttcttcgcccggatgtggttgaagcggcgctttaatattacgacgagcatgttttaggctcggactgaaagacaagctgatggcgtgcattggcttgtctttttgtcgattgcaagtggtcattgcttgttattcacctagttagcttttaaactggtgatacggatgtaatgactgaatgaaagttgtgtgtgaagtacgctcggcccaacctggaacattcggttgggcgttacaggcttaaaataagaactttctgaaaatctgcgcaaccccttgcatttatcgcgatgttttgttacctttacagataaaaataaaaacataaggagctaacgttcaatgtctaattgggatacaaagtttggaaaaaagggttatacgttcgatgatgtactattaattccggccgaaagtcatgttttaccgaatgaagtcaatttaggtgttaaacttgccgataatttacagctgaatattccaattattagtgcgggaatggatactgtttcagaatccgcaatgggaatcgcgatggccaaccaaggtggcttagctgttatccataagaacttaagcattgaagcgcaggctgaagaagttaagaagatcaaagcggtcgttaaggatgatgatcacccacacgctgccgttgatgccaacaatcacttgttggccgttgcggctgttggggtcactagtgatacctttgaccgggctgaagccctatttgccgctggtgcggacgccatcgttattgatacggctcatggtcattccgctggtgtgcttcgaaagatcaaggaaattcgggcccacttccctaagcagacattgattgctggtaacgttgcgacggcagaaggcacgcgtgctttatttgaagctggtgttgatgttgttaaagtggggattggccctggttcaatctgtacgacccggattgtcgctggtgtcggggtgccacaattaacagcggtttatgattctgccagcgttgctcgcgaatacggcaaagctatcattgctgatggtgggatcaagtattccggtgatatcgttaaggccctcgctgctggtggcaacgccgtgatgcttgggagtatgttagccggaacagccgaagcaccgggtgaggttgtctttgacgatggccgtcaatacaagttctatcggggcatgggttccgttggggcgatgtcacaagctcatggttcgtctgaccggtacttccaaggcggcgtgaacgaagcgaacaagttagttccagaaggtgttgaaggacgtgtgccattcaaaggcagcgttgatgatattatcttccaaatgttaggtggtttacgttctggcatgggctacgttggcgctaaggacattgatgccttgattgaaaacgcccagtttgttgaaatctctggcgctgggctccgcgaatcacatccacatgaaattcaaattacaaagaatgcaccgaactattcagtcaacggttaaaatgacgatatcgtatgagtcagtctgattggtttagttgaataagcatcaagtaagcgtagaacatcaactttgttctatgctttttttgtctggtgagtaccagcggaaaatataggcagatgtaacgatcgtgtagattgaccgtagtgcttctttcttgttaggacgttgatactagctctgtacacgattgtgttacttattaagttcattagatttttaatgatatcgtggtattagtgatgcaaagaaaggggctaatataaatgaagtatcggttaataggggtaggtgcgagtctagtcatcgcagtcatgttaacagggtgtcaagcgaaggctacgacattggtcaagtcagatgctggccaggtcacacaagcggaagtatttaaacaaattgaaaaccaggcgacgacgcaacaggctgttcaagaattgactctaaacaaagtccttaatcaacgatatcatgtttcacaagctgaagtaacagctaaattaaaagcattcaaacggcaggcaggcgcaaattatcacatgattttagaacgtaatcatgtcactgaaccgcgtttaaaatcgcaaatcaaagcgaatttattgatggagaaagccattagtgctaagtatccagtgactaaagcacaactaaaaaaagcccgagcagcttatatgccaatgacaacggttcaacacattgcgacggccaatgagaagcaagcgcaaaaaattattgctgaactgaatgcgggtgctagctttgattcgcaagtgcgaaaatatcagaataatcgacaagcgcacacaactgctggaaaattagcgcagtttgacagttataatcaaactctagcaccagcaattgtacaggctacagccaaactacgagtgggacactatgtcacgaaaccggtcaaaacagttatggaaactgccgacacgaaagacaaaccaacttatgaaattatcaacgttgtcagtcgtcgatctaagactgcggctgtaactgatgatagcggtaagcggattgatgtgacaaattatttgcgtgaaaaaatccagcaacagcggatgatggacaagcagacgcaagttgcgacgattcggtcagttttcaaagcggcccacgttaaggtagttgatgcccatttcgcaccagcgtttaatgattatttaaccacccaaaatagctaacaatagaatcatcagcaatgatgtgatgattatgaacgcgtctcttaacctgtcatgggttaaaaggcgcgttttcgttaggtactgatgattaattgcgctatgatggacttattaaaacgtattgtaccagtttagtgaggtgccaaattcaacatattaagtaggtgagtagatgcaacggtttcagtcacgccatttattccagttacgagaaattggcttgggcttaacctgtatcggtggctttattgacgcatacacattcatccaacggggtggtgtcttagcagctggtcaaacgggtaatttgatttttctcagtgttgatgtggcacagtggaatttaccgggtgtgttgactaaattagcaacagtcctcttttttacactaggtgtaattgttgtgggtatactgaaacaatggttgggcgcgcgatcacactactggcgcttgcccgttttggtggcagagctggttgtttgtttaatggtcggcatgctaccagcgactgttagtaatgcgatggtggtcccaccactcgcattcgtgatggcgatgcagacgacagccttcagcgcaatcgccggccacggctataataacgtgttctctactggtaatctcaagaaggcaacgatcgcgctgacgaattattggttgacaggcgtgcgcacggagcttgacactggtttagtgtattgggaattagtgttgagctttgctacgggcgcgattgtttcggcgatattgcagcggtggtggacattacggacgatatgggttgcggcgggattattgattttagtaggtggatactatacttggttattagttcaccgtacggcaaatgacgcggaatagttgcgttttctctaaaatcaatcgttaactgccaagcccggccgcttttttggtaaaataaaaacagaattatttaaggagaaaaataagatgaaaattttagtagtcgatgacgacaaagaaattgcacaactattagaaatttatattaaaaacgaaggctatgaaccaattagcgcctataatggccgtgaagctttgactaaattaaatacgaatcctgatattgcgttaatgattttggatatcatgatgcctgaaatggatgggattgaggtcatcaaagaagtacggaaagattcccaacttccaatcctagtcttgtcggccaagactggtgatatggacaagattcagggcttgattacgggagctgacgattacgtcaccaagccattcaatccgcttgaaattatggcacgggtcaagtcactattacgacgttctgaaaataacgtgacgactaccgagcctgatattttggacattggaccgttaacgatcaataaagattcgcacgaagttaaaacgttgacgggtaaggatattcaattaaccgcgttagaatttggtattttgtatttgctcgcaagtcatcctaaccgagtcttttcagctgatgatatttttgaacgtgtttggcagcaagaaagtattgtctcagctaagaccgtgatggtgcacgtgagtcatttgcgggataagatcgaagaagccacggatggagaaaaagtcattcagaccgtttggggcgttggctataagattgaatcgcgttaagagtgagggttagcttttgaaattaacgggacgcgaaaaaagtgaattattttttgaaggggtagtgacggtgattttgctactccttttaaacttgtcgatcgtagtactgatcaacagtacgattgcgcataatccggggttacagagcggtattttccaaattaaacgatcgattaccattggtcccaataactaccagctatggagttatgaaaacatctttattggactgatgctgattgcggacggtttcgtattatattggcgattaattcgacgatacaaacagatgcagttacgacatattattagtgagttgcattatattgcggccggccactttgaccatcggattgactttaatctgactggtgatacacaacgagtcgttgaaagtgttaatgccttagtagactcggcaatccactcgatggacgaggaacgggaaattgagcggtctaaggatgcgttaattacgaatgtcagtcatgatattcgaacgccgttgacgtcaattatcggctatttaggcttaattgagaacaaacagtaccaatcagaagaggatttaattaaatatgcgcatattgcctatttgaaggcaacacaaatgaagtcactggttgaagatctgtttgaatatacgaaatcacggcagacagagacaccgttggccattaatcggttaaacttgacggccatgttagaacagttagcggcaagctttgagctggaagcgaacaagaagcatctgaagattgaagtagaaagtggcacgcagcctatttacattgaagccgatgctgaaaagctggggcgggtcttcagcaatttgatcactaatgcgtttaaatatggaactggtgctaaaaacgtagtattacaagctgaacaacgtggtgaagaagtcgtgattcacgtcacgaatgatggtcagcgtattccagctgagtcgttgggacgcttatttgaacggttttatcgggttgaagaatcgcgttctaaggcgaccgggggttctggactgggcttagcgattgcccaaagtatcgtggatcaccacggtggctatatttatgcgcaaagtgatgatgagcagacaagttttgttattcatttgccagttaaacatgaccacccattaacaaaaaaacaatcggatatgataaattaacttgtttccacagacataattatttaaactaaaactagcattagcaattaagaaagggataattgagaaatgagatttgcgggaaagttaaagaaagttatgattgccctcgttgcggcagtcacgtttagtacagctggtttaggcattgcgggggctgacctccaggcccaagcagccagtacaccatcgatctctgcgaaagccgccattgcggttgacgcgtcgaccggtcagatcctgtatgataagaacagtagtaagccaatggcgatcgcatcaatgacgaagatgttaagtacatatttagtgcttaaggcgatccatgaaggtaagttgtcttggaatcaaaaaatcagtgttagcaaggcagtcgctaagatgagccaaaacacggaatatgcgaacgtaccgttattatcaacgaagacgtattcagtgcggcaattatataacgcgactgaaatctattccgctaacgccgctatcacagccttgggtgacgcggtagccgggacgccccataagtttgttagcttgatgcggaagacggctaaatcatgggggatcacggacgctaccattattaatgccagtggattaaccaataaagaggttggcagcacaattgggtacagtaacgttgccgccagtgctgaaaacgaaatgtcagcacaagatgttgctaccgttgcgcaaaagctattatcagattacccagaagttttaaagacttctagcattgcccatgcttggtttgaaaagggcactagttcagcaaccaagatggataaccgaaactacatgctcaaaggattagttaaacattactccgcacttcctgtggatggtttgaagactgggacttccactaaggctgggaatgccttcactgggaccgttaagtttagcaatggtaaccggatcattacggtcgtcatgcatgccggtgccgctaacgatagtgggacggaacgtttcactcaaacggctgaaatcatgtcatatgtttaccacaactacacgactacgacgattaacaagaatggcaagatcaatggtgtgaaagccgttgatgtccaagatgggaagtccttaacgtcgcaactcgtttcaaatagtggtgcaaccaagatttacttgccaaccgggacggatgctagtgccgttactggtaaggtcagcttgaagaagtcggcgacaaccgatggtaaattacaagcacccgttaagaatggcaagactgtcggtactgttaacttgaacctaagcaagaaagctatcaaggtagttgacggaacgactagcaagaatatgaccatcaatgtaacgcctaagaagtccatcgacaaagcaaatatctttgtacggatgtggcgcggggttaagagctggttcaactaaattatagcagttagtgtattagattctgtgggtgcattagcttagtaaacgctacgagatatttcttaaaagatatattcctctttgagtaggcaagctagtaattgagacttgcctgctcaaggaggatttttttgttggcaatagtgattcatgacaggcaactaatgaccagggctgtgccactgatttagctaattaaaaataattagcatccagagtaatttcaaaaaggcactgtcaaggatgaccaagttgaacggctgcggatgttatgataaaaagagtattaatagtcttcatttggcgatgctaaaaaagcaacgtttaaatcgggataattatgaggtgctttgttaaaaattattccctaaattaggccgtgtgcctatcttagtcactacttcgactattcgctacaagcgttccagtttgagcgttctttctttttttgctaatatttgaatgctagctttgcggataaattgcgattccatttatgtagaatttgttagcatgatccacgattaactgtataatgaagactgataacagtagttaaaccgaatggagtgaaagtcacctatgagcgtatcattacgaactgcaaccatgtcagatttacccattattgtagatatttacaatcaaacgattcctagtcatcaagtgacggctgatcttaaaccagttacggttgagcaacgtcgaaattggtttttgagtcatacccctgaacactatccgctgtgggttgttgtaaaggacgactcagtggtcggttgggttagtctgtcaccattttatggacgggcagcgtatgcaaagacgactgaaatttcagtttatttggatcgcagtgttcaaggacagggaatcggtagccaggttttgacattagttcctaaacaattacctgtgttgggattaacaacgattatcgcttatattttttcaagtaatattccaagcattaagctgttcaaaaagtttgggtacgaacagtgggggtttctgccagaagtcgctgaattaggtggccgaccgaatgacttagtgattctgggacaacatttcaagtaaaaaatggtattgataccgcttacatgcacttaaaaacttaacaaggtgtaggattgcaataaaaaacatgttaaaattaaatccgagtgtctaagtaatttgacgctcgctgttgttgctagaattctttactggtatggtactggaggcattcttggtgaaaaagaacgagccaaattggttagtggtattacgaacagtaatgccgcttgggcttagctatattcccatcgggttagcttgtggggttttattgcatgcggccgggttcaaccatctactgacggcgttaatttcggtaatggtcttttccggtggcgcccaatttttaattgcatcgatgctgacaattaatgcaccgatgacaaccattattttgatgatgtttttcttggagttacggtacgccttattaggttccagcttatcgcgctatctgaaggggcaatcattaccgttcatttttacgtttgcgttttcgatgaatgatgaaaattacgcggtcaactatttaaagtttgcgacggacaagcattggaagccatcgcaggccttaatggtcgaacactattcgttattattttggacggtaagtaatattatcggtagtttgattggcagtgcattgacgattaatctccaagtggtggattttgcgctgacggcactattcatttatatggcaattatgcaaactaagagccgcttgattatcttagtggcagttttgtctggcgttctaacgataggttttctggtcttaatgaagagtacgctgggcctagtggtgtcaacactactcgcgtcgttgaccggttactttattgaacgttacttgttggcacataagccagaaagtcatttactctataaggttcacgatcctactggccaaacagccatggaagaatctgacaagtagggcacagaggggtttttcttatgcaatcagtcagctcaatgagtagtatggaccatttttggttggtcattttttgtgcgtgtgtggctttcataccacgctttttcccgctactgttctttacgaagcggaagatcccagaatggtttaatgaatggatgcggttcgtacccgtctcactattcacggcgttagttgttaaaagtgtctttatcgatagtaagtacgcagtgatcacttctggcaatctggggatgattatttctgctattctcgttggatttgtggcttatcgtacgcgttcaatgactttatcagtggtgattggtctagtctcagtgatgatttttgtgttactaattcatatttagattttgttggaactgggtgacccggttcttttttattatgatgaaaagaggatacgttgatggtatggttattggttttcttacccggattattggctggtctggtccaagggttaacgggctttggtgcggccatcgtcatgatgatctttttaccacagttgtttccgattgctcaaagtgcggccgtggcgggcgttattatggcagccagtgtcataacattagtttggcgttatcatcagcatatccactttcgtcagattattgtgccgtttatcgtttatgccagtgtggcggcctattcggtacatcttggtcaagttttagatgtgcaattattgcgacggttattaggtgcgctgttagtttcgttagccgggtactttagtctgagcaaacgtgcggcgaatcagacttatccgtggtggttagccggtctcttcatgattatttcggggttcttcaatgggttattcggtattggcggcccgctgatggccctttattttctatcacttgccgatacgactgcggattacttgggaaatttgcagactttctttttgatcgatgtggtctatatttcgacagtccgcgtactgaacggtattctgacgccagtcttgctcccccatattatgattggtatggtaggtgcggtcattgggacggcgctggcggcacgaatcctgccgcggctacccatgacgacagtccggcatttgatctacttgttcattggacttagtggcgggtattatttgattgcgccagtttagaacgaggaatttatcaccttcactacgagttgattttagtggtcaggcgcaatgcgtttggtcttttttgatggtgcaaagcgtccaagtgttaaaaaatattttcagaaagcagcggtagcacttcgacaatctgtcttcggttataaacgagttaatcccaatgtataaattgaatattattaatttcataatcaagaatttgccagctacagctggaacagtgcttatctgttttgggagcggacgtggatgcgtaagatagtgccgttgagcgtgcctggctgtagcttcttaatcggccttgcgcacggttctaaagttgaacaaccgggattgaaatatttattgttgaagattttttattttaacgatgcttaattccaggtgctacatagctgaaaaaagcattggcttattggtttccttttagtatagttttattccaagaactgctaaattggggagacatatgaatagctacagacgaattcaagttattgcagggatttacttgctgatatacattgcggcactttacttttcgacgggggttcaggttggatttaagctggatagtaatcagctcactgggtatgtgagctgtgggctgttactggctgtaattatggggtcagggtttggcaaacgattaagggtaaaaaagctattttcgattttgatactagttagttgtttgattattctagggataactagattcaatgttgtgagttttaacgaggccttctggtactttatcttatttgttcgatacatcccgttcattgtgttgattgaaaccatcatctttatctttgacctagattgagcaaaccaggccctaatgagcattcaactcattagggcctggtcttttattattctaaaacctggttatgccgaacttttagttggcgtgagtctgccataggacattagtgtggatgttggcaactacgctaatcttcgtcggtaatcgtgcctagaccgtattgataaagtagttcatcagtacgattaagatcaaagcgctgactaagtgcgaagatgaccagagcatcccattcatccttagcataaaggacggcgtaaccagttcgcttgagcatcgtgttaagctcggtcagggtcagttgaaaaccgaatccgagggcgatgatgcgagcccggttaggtcggcgcttgccatcgaagtactggtaaccgatcgagggcgttagattagcgcgccgaatgacttggcttttagtgacgtgtttgatttgaataagctcggcgaggtattccgccggattggtacgaataaaactagtggccatatttgtcataaattggtcggcctcacttgcatgtttgatttcgttaaatagttccttagttgcgcgttctaccacggttagtgcccccctaatactccttcttaattagtattagtgtaccagaaactactgtaatttaaaggtcaaatgccgatcactgaagtagctgggattgtagatgagttcaacggacccatctgctttggcttgaccagtcatggtaccactgacagagccaccagcggtcaggtcaccactatctaattggttattttcatcaatgttgatctcatctaggctagtttggttaccggcggccttgattttaaagtcaaacgggttatagctgactttatctctaccgctatttttcaatgttacggtgaccgtataatattgattgccagttttaggctgaacatcattgagcgtcgttgcggttttaacattattaaccgttacttgcacgtgatcgatggtggctgtctgcccgactttataaatcgtatttgccggggtttccttagcggtggacttgctagcgctggtctttttggtcgtcgctgcttgtgagtttttaccgtcttgtggagaattgacgaggctgatgacaaagaagatgccaaggagaatcaggacccacgcccaccatttttgataccaagctttcgttttttgcatgagcttacctactttcttagtgctaagccgcccgcaataacaatgagcagaccgcttagaatcccgaagaagctgacaaagacgaagttaagaatcccacaaaggatgatcaaccagcccattaaaacgtgattgcgattaatcatgacacttaaaataatcgcgaggacagagacaataatgcagccaacgccaagattgctgaccccagccgatccgctggtttctaaagcactaccgatgccgccgatggtcatcgccagtaagccggcaatgataccgaagataccgccaataattcctaaaactaattcggctgttcgcgaatggggtgcgactggtgtgacttcgttattctgatattttgacattgtaattcctccaaaagtatggttatgataaaagttagtaattttgataaaaaggggggtgtcacggtgttaccgattgttcaagcaatgcaattgttaagtacggctggttatgaaccactaggaccattagttgcgcaacgcgagtttccgttactggttaagaagcaacaggttgtttcggtagctaaactagtaaatcctgataatattcctgttctacagcgtttgaagcagcagccaattccccgaatgccccggatcgaagcattattaacggcggctgattgcattgtaagtgttgagaccttaattaatggtcaaacactagcggatcgattggcaacacaaggaccgttttcccccgaaatgacggtgcgcgtcgcacaagaattgttgataacgctacaggcgttggggcaacaacaaattgtgcatcgggaccttaaactaagtaacgtgatgtgttatcggaatcactactatttgattgacgtcaacgcagcgcgacaatatcatgctgagcaagacagtgatactcgtttattaggcacgagcggttttgccgcacctgaaaactatggcttcgcccaaacggatcaacggagcgatctatattcgttaggggtcgttctaaactgtttgttgactggtcaagagccgagcgggccgttagatacaacgacactgacacaggattcaacatgggccccgattattatgaaggccacggccctagacccacagcaacgatatcaaagtgcgactgcaatgttagcagcgttacctggtcatgagcattatcggccgcaccatcaatcaatgattaagcgaatacaggcccggcaatggtggccgaaaatcaaacgacctttacaaatcagtttgtggggtctctacatcttgctcgtagttgcgaccattggtgctggctttgataacacgacttggcccgcccgcgtcgatttttggaccgagggttttatgattatcggggcgccactgattgcgcactatgccaatcagtggctaaaacaccattggtcggtattacgctggcatcgatatcggtggtggttacgagtagcagaagccatcttcatatttttgatgttaggccgtaacggctagtgtacgtaggctggttaaccaattactagtacgataaatagcataaccgtttagttatcaaaaggcttatgcaaaatgcataattttctgactgcggtgacgcgacgactgaattcgactgggtaagactttactcagtcgaattttgatttataggtcaggaaagtgattgaaaataatcctgaaaactgttgatgtgttttcaggattatttgaggagacgattgtatttatggtacaatgctagtcgttgacacttgataacataaatgtatctaattaaatataagaaaggaatattttgtcgaaatggatttaaagcaaagcgatggttggcgatacttagctgggtggagcttcattctattaatggtggcgagtgccacattgcaacatgatgcggaaatcattttacccgaaatcggtgctctgacagccgggacgtgggtttatcgtaagacggcgtggactcggcaacccttaaagttattcttagtaccatctggaactgcaattattggcttcttagtcaatcaactaccttggtcgtacgccctcaaagtgcttgtcggtctattactgatgctattattattgaaggggttaaaatcgaatttggcgccagcctttgctactggcttactgccaattatcattaatgcaacgcactggacctttatcgtagccatctttttctggactatttgcctgatgattggggcttggattcaacgaccgcgatcaatctcacgggtaaccgaagcttctgctagtcgctggcaaatgctcggctttatcggcctagtttttgtctgggtgggtattgtttggctagcgggacagccccagatggccgcaatcccacccgtgatcgtcgttttctttgaagcggctcaacagtctgaatatacgataacgaccgcacttaagcagtggcttgcattgtcggctgctgctagtattggggtcggcattcacctgttgattgcttcgtggctattaacgacggtcattgccttaccacttgtgtatttgtggttacgggcgcttaacttacaattgccagcagcgtatgcctttccactattagccttagtgttaccagccaatatgtttaacaaactaccgacatccgccggtttagcggccgctttcttcctaggatcgttactcatctaccatcagatcttgggttgggtacgcatggcggtgactgaaagctagttgtcagtcattcctgaaaaatggtcaaaaaaataccaactatttcgaaataatcgagatagttggtattttggcatttaattaagctttattgattcggttatccgcatacatgtatttccgggtcattggtaaggttcgtgatgaagcacctttagttacgaggtactgcatgacgtcaatgttaccagactggaaggaagcggcacaggcttgtaggtagagatcccacatgcgagtgaagcgcacgcccatcttttcttcgatggcagcgcgcttagcgttaaagtttttatcccagatttcagtcgtccgttggtaatggcgacggagggtttcaacgtcagcgacttgtaagccggcgtcaacaatgtgttgtaagttttcggtcatcccaggaacgtagccacctgggaaaatgtacttatctaaccaaccgttagtggcgccaccttgttgccgggtgatgccgtgcaataaggcaaccccgtcagctttaagatagtggttaacgcgttcaaagtacattgctaagttgtccttaccgacgtgttcgaacatcccaacactggtaatgtagtcgaaagtttcgtcgccaagttcacggtaatcttgtaaccggacttcagcaacatcactgaggccttcatccttgatgcgttgagcaactaggttatattgttcttgtgataacgtgaccccgacgacttttaagccgtattctttagcggcagtcaacatcaacgtaccccaaccgcaaccaatgtctagtaaggtcttgccaggttgtgggttgagcttttgaatgatgtgatgaaccttatgaatctgggcttcttctaatgtatcagtgtcatgtttgaagtaagcacaagaataggtcatggttggatcaagccacatcttgtagaagtcgttacccacatcgtaatggctttggatgtcttgttgactcttcttttcagagtgagattgtttaggcatgaacttcttgaacttagaattgttgaagaaactttctgccgattcataggccgattcaattaatttttgaatactgccatcaatttcaatcttgccatccatataagcttcaccaagggcaattgaagcgttcttggtaatttcacgcattggaatggcttctttaaaagtcaccgtgacttctggtgtgccttcaccataagtttcactacttccatcccagtagttgactgtgacgggcatattgaatgagtggcttagaagggtgtggtaaaaggttttttctagcattgcaataaggatcctttcttcgtaaaatacactaattattatacgcttatgaaaacagttttgtaagcacaacgaatcgcgacctgattcgtaaacatgttataataaattaattacaaaatcagttgatgggggtgtcgtgatgaaaagatggatgtggatcgtgtttgcagtaattatcgctgtgggggttggtagttattcatatacgcggtaccgtctgcaggaagactcatacacggctgaaatgcgaactggtgagcgggcactgcaagagcggaattatacgttagcggagacgagttttacacatgcgaccagaacgaaagctagtagtactgaggcgcaacggtatttaacccagacccagacttatgtggctggtcaagaagcactggctgcgcggaaatttgacgtggctaaacgtgactttatgacggttaagacgaccaagcacggtgcagttacgttaattaatcaggcccaagaacaacttaccttaataaaaaaggtgcaacaaaaacgcaagacttatcaacaacagtatcagaaagctgctgagctgaataaagcgaatgagtttacggattctaacgttgtaattgctaagttattgcaggataaggcgtttaagcaacgttactatcaggatattcggaaaaatgtgttggatttacagaaacaaaataatgcgtcactcaagacattgaccggttcagcaccggtgatcccgagtgcggcacaagcggttacagggatgaccggaagtcagcaacaaacgcaacgcacgccagccactaaacagcaggcggctgcttcatcatcaacttcctcagctaaccattcgatgggctcgtcagctgcagctaacaacagttatggtgacagtcaagtgcagacgactcgtgctgagttgactgcgcaagggctcgacggcagtagttatagtgatgcccaaattcgtgctattctgcaacgagcagcggcgcaacacctctcactggcgcaagctgcccagacgatgaattatagctctgatcagattcaggcaacgcgtgcggagctagcgcaagctggatttaatgctagccagtatacggatgcccaaatcgaggccattttacaacaagccagtttacaacatatgtctctggcgcaagcagcgaggtcgttgcagtaatataaacaatttaataacagtatggaagtccacttaacaatcatcgataaaacacctacttttaggtgtcaatcggtgatttttttataaaaactgttatagaatgtaggagtaaggacggaaagttttcgttcttgatattttggttctacgggggcggtcattttatatcggtattggcctttttttaacgttcatatgtcaaaatgggtataaaattgactattttgtgtactatttttgtttgatgctatagaatattaacagattagggggttaaggtgcccgttgatgattgaattaatggcagaccaaattaacatgatttggtaaagtagttcgattgtcaatggtgggcatcgaaattcagtatgattattaataaacatgtaatgcgcagtacgaatgaaaagcaagttctgcagcaggttattaacgaaggaccgattagccggagccagatttcacggaacttgagtttgaataaagtgacggtttcagatatttataatcagctactgcggacccagttcatcaaggaaattggctgtggtgtcagcacgaaaaacggcggtcgtaaaccggtgatggctgagctgaacgtgaactatggttttgtggccagcattgacatgacggctgacgcagtcaaacttatgtattcacggttgaatggtaaaattttgcactttcaaagctttaagacgagcgatatgacgttgacggatgtcattgatttgattgaagatcaattacggaacgttgatgactatggtacgattcatggtctgatgggggtcgccattgcgctggatgggattatttatgagaataaaatcctcaagacaccgatcaagggactaacacactttgatctagcaaagtatttacgtgataagctacggattccggttgttctggaaaagaaagctaacttaacggccgtttttgaacgtgatttccatgacaacgagattttcgataacgtggtttcggtagtcgttcgcgatcagattcatgcgggcatcgtggctgattcgcgactatattctggtcatgaaggcgaagcaggtgaagtggggactgctttgttagaagatcggcacgttgaggaccacttggcatcagttaacgattatgcttctgaaaaagccttgtgggctcggttgaaggccatcaagcatgttgaacgattagatttaacgacggtcaagcatgactacatcaatcatgatccggaagtgacaaaggtcttcgatgactttgtttactatctatctaaagtgattgcgaatgtttccacggcgttcgcgccggatgtggttgtgttgaacacgaccgttctagaaatcttgccacaactattgactaatgttcgggagagcacggccaagctaacttcgccaagcattaggattagagagcttaaagatgcagttctcataagtcattaagtgtttatttaaacgaacgtgtgaagtttatcgagtgattagtgataaacttgacacgttttttgtcgattcacaacggccttttaatttttattgctgagactttccgttagaataggagtaagggatagtagaggggtggatgttgtggaattttggtcacagttaatacgaaatgtgcgctggcggcgcgcctgcgtattggcgttgattgtgttaacgctatacttggcatcaagtatgatgagtatcattttattaacgtttatttttacgttcttagtgacgcggttagttcgggcagttcggcggtgggtgaagattccaccgacgatcattgtcctagtggtctacgcactagtcattcttggaatttactttgctgtatcgatttatttaccgcagttgatcaaacaaacttttttgacgtttgaatcagtctatcggttttatcagaacccatcacatgatactaaccaagtgttgacgtgggtgacatcgtattttcaagagtcggatatactcaaacaattgaagggcggtatttcagttgtgttccagtatattactaatattggtaatatgggactaaccttcttcttgtcatttattttgagcttcttctttacgattgaggatcatcagatgcgggtcttcacgaagcgctttttgaccagtacgtttggctggttctttcaagacgtccatttctttgccaaaaagtttgtgaatagctttggcgttgttttggaagcgcagttcttgattgcgattgtcaatacggtgattacggtagccttcatggcaatcttgaagatgcctcaactgattagcttgggattaatgatctttattttaagtctgattccagtcgctggggtgattatttcagtcgtaccgctgagcttgattgcctattcggttggcggtttgcgctacgtggtctatatgctcttaatgattttggttgtgcacgccctagaagcctatgtcttgaatcccaagtttatgtcgagtcgcacggagctgcccattttttatacgtttgtcgtattactagtgagtgagcgtctgtttggtgtctggggactgatcgtcggtgtaccgatttttaactttattttggacatcatcggcgtgaaaccggttcaccggccgcgacctaacattaatctgaaaaaaacgattactttccacccggattctgaaaataagcgctgatattgttttgatttttcgctttttcagtgtaaaatagggtgagtaaataacttaagaaagaggtcattaactgctatggcaaaattagtattgattcgtcacggtcaaagtgaatggaacttatctaaccaatttactggttgggttgacgttgatttaagcgaaaagggtgttgaagaagctaaggctgctggtcaaaaagttaaagaagcaggcttagaattcgattacgcctttacttcagttttgactcgtgccatcaagactttgcactatgtgcttgaagaatccgaccaactctggattccagaaaccaagacttggcgtttaaacgaacgtcattatggtgcattacaaggattgaacaagaaggaaaccgctgaaaaatacggtgacgaccaagttcatatctggcgtcgttcttatgatgttttacctccattattgagtgccgatgatgaaggttcagccgttaacgatcgtcgttacgctgacttagaccctaacatcgtccctggtggcgaaaacttgaaggttaccttggaacgcgttatgcctttctgggaagaccaaatcgcacctaagttattagacggcaagaatgtaatcattgctgcccacggtaactcattacgtgccttaagcaagtacatcgaacaaatcagtgatgatgatatcatggaccttgaaatggctactggcgaaccagttgtctatgactttgatgaaaagttaaaggttcttggtaaggaaaagttaggcaaataatttaatagttatttactagttttttggagcactccgctgtctcaggggagtgcttttttgggcgctgagggccgataacgtgtgatgtggctggcagttggtgacaaacggacgctggttgtcattatgaaaactaagctttttgtttcagaaagtaaccgatcttatatatttagataaaatcaattatgatcaatgatgatgaagagtcacttgaaggtttgaggattcttgaccgagcaattgttaatcagttaaattaatgaattaagcgtggtggtcgctaactggtcactatttgatgaaacagtgattaagcattaggggctatgcgggtaagttcaaattaagcccccaatcctcccggtcaaacgtggagattggaaattgaggatttaaaaggggataaagctgaatgaatatcaaaaggtacggggtcgatgcgccgtttgcgctattgatctacaccgcttttggtgtgggactagtgttacatgcctacgtaaatcggttgaactatccgattggcatcgaaatgacgctgggaattatattattgttgggtgcgttgttatttttgcacaccacggcacaggggaagtaccgactgtttgatgaggcgattcgccacttgaacttgacacctgacagtcagctcttagacttaggctgtggtcggggagcactgttgaccaaaatcgcccaacaattgggaccagctggcaaagtaaccggattagatctgtggttgtcgcgggaccaatcacataacaaaataaccgtaacacaaaagagcgtggatgatttaggattaacgaatcgggttaagctagtaacgggggatatgaccaagttagactttcctgacgcaagttttgacgtggtgacgtccagctttgccatccataatatcaaaaatgaacaagcccgaatcaatgctgtcaaggaagccattcgggtgctcaaacccggtggacacatcatgatcattgatacgggtcgcaatatcaacgagtacggtcaggtttttcaagacgctggcttgcaaatcatccagtcaatgagtttaggatttaacggttggtgggcgaccccgctaactgatagttacgtggtcgctggcaataagccaacaaataaaacggcaaaataagattaaagaagagaattggagttatagttaaatatgagtgaaaaagcaacagaagtaacacaacgtgaaatgattcgaattattggcttgttccggaagcaagggtttaagggcaactaccttagttttcaacacgtcgtcgatgaaggtgctacgtacttcgttgtcatgggtgacgagaacaatgggaatcaaggcttgtttaaggccaacttgttaacgggtgaggttgctttccagtatatgctggatgaagatcacgtcgtaacaaagtaaatagtagctgattagtgtaaaagagtgacttcaattttcgaaaagtcactcttttttagctatcgtcattttttaatcattgtacaaagcaaatgtaggccaggttcagaatttgaaatcaatagtttttttaagattccgattatattttcaaaattgttaaatcaagtgcaacacgtataatttatttatagtccgggcaaaaataaaccagcagataccaacatttctgattattcagaacgttggtatttgctggttttaaaataatatacaacagaatcagctaagcaacatattgcgtgtagtggatacctaatcgttgagtgattccggtaacttctgggcgattatgtacgtggattttaccattacgaatgaagtccattgtacatgatcatttgctggaccccgtgagattcaattccaatcaagtcggtgtagatcaacatgtggtcgacttcctggctttatgtgtcgctgaaactgtaacttttgtaaatcagttgttcaatctttttactattgtatcgttttgccattgtattcaccacgttatttaaaatatgtctatgtgacagcttggctgattacaatatgataataagatagggttatattgttaatcggtgttcaatctctttttaattatatatttattaaatgcattatcactcaataagtcaaggtggatttttcaacaccataagcgccgatgcgcagaacatagacaatcttgatagctttgaaatattcaatattctgctgtttattcggacgtcctgtatggatagcataacccgaactaaaatgaaatgcacaattatttttaaaaagtgatttagttacaatgggtggttaccaccccgccttgtttagggttaaagcagctattttgttcaaaaacgtatacgatcaaacgagttgctgattaactgggcatgggcgtgtccaaattacattattattgtccagcttgaacggatgtccaacggttatcggcaatttacagatgccaatgtgctttggttaacgcaaatcaaggtcttcattggttctgggatatcgttaaaagatattcagaaactgactcggctggttttaacaggcaaacaagaaacgctggctcaacaacgggtgattatcaaccagtatcttgtaccactcataaaaagcaggtcgaaacgtctgcccagattacggttattcaagattttctggctgagcacccattagataagaagcaagattaattatggcaactgttttagtaggcgcttcgtcacccactgcacaggcgtttattcgcctgattaccagcgattatccgcatattaacttgaagttatttcggccgatttgaagcaagcttatcccgttattgtgggagatgcggctaattatgatgactatgttcgcgctctagatggcggtgtgacgcacatctacaattcggtaggcggtgttaagatgggagcgtatacgcaaacgctcctgaaagctattgcgatgacgcacgcgcccattgagcacatcggcgacatttctgctggtggcatttacaatgaatttcggtccggaatccggccgtacctctcggctgtgcgaaccctctatccgaaatatacccgagatcaagtgcataaattagattggtatcgggattctggattggcgtttactatttttcgacccggcttgattaaggatggctctgagactgaaatcgcgccccctactcctgaccatcatgatattcacgaggatgaatttgatattaactgaagtacgtttgtgcgggcggctaccaacgtgttattcaatgatgattaccataactaaagcctttctgtgcataacggcgcgatgctgtaatctcgagataacgaaattaagttgtcgttgtatattggaatagtgccaagggaacaatctaattagcagactagagttcgacaaataaccactttcatagttataacgaccgtagtggtggttatttagatagctggataatgaatggatcaggaggagttctaagacatcatgaattaaaaaaggttcaactaatcgcagatttataaattagttgggctttttactttggtctaaaattgaatctccattgaaaatgaattgtgctgaacttggattgtatgagaatatatgacgtaccaacacctaaaattaatcatatttattaatgtacttatttcacaatctaaaataatctcaataggcacgtgattttaaacaatcggtccaatgggtacactgaataaaacaataattggacctaatgaagcgcttacattttagacggtgaagtattatatagacaaggaggttgattcaacatgagcgatcgcaaacatgaaatactccgaaaactaattcagaatggctcaatgactcaaactgatttagcagcgaattttgatataacaaaccggcaattagtttatattgtcgaacaactgaatgaggatctagctaatcatcatttaccttcgattgaatttaaacgtggaattttctatagccaccctgagcaagggcaactattaatggttagtcgtaaattaaatgaaattgtcttcactccggaagaacggttgtgtgtgctacagatcatgttactaacgagtgatgacgacatctttctaaatgcaattgaaatcgacttacaaattagtaaaaatacggcgctgggtgatatgaaacgcttgaaaagtttgcttggaaaagacgatttgaccgttcgctttgcccgaaagtgcggttaccgcatttatggtgatgaatggtcacaacgcgtaaaactaatgcaagccatttcaataatctataagcattatggcgaacaggttacgacggaactactaggacaatggcactcatacttggaaattacgcgcaataaaattcagagtgtggaaagctatttggaaatcaagtataccgatgaagattattattcgttgatttattttgtatccgccatcttggtacgcgtcaaacacgggagcttaattaatggggatagatttgatgatcagccagatattgagcaaacgcgtgagtatcaggccctctatatgggaaatgacgaatttacacaattacccaaacaagagaaagcctacgtagccttaaacttactaagcgctggtgtacggagtaggtctgagttgaatgatgaactctctatccgattatccaatgcgttatgggaatttttaactgagtttgaagctaaggcaatgttggtattaccggataaaaagaacttgctgattaaattggtggaccattttacgccggcttattaccgaattaaatatcatattccatccaataacgttttgtataacaaaatcaaatcaaaatatgaagtgctacatgattttgttcgacaatcagtaagtcccattaacaaattctttggtactgagatttctgatgaagaagtggcctacattacattgtttattggtggtcatttagttgataatcatcaacctactgtgggccaaaaaattatcaaagtagttgttttatgcccaaatggcgtttccatctcacatattttagccaaaagccttaagaaaacttttccggaattcatgttttatccaccgagttctattcgagagtatgcgaactttattatgccacatgacctcgtattttcgacggttcccgtagtttcgggtaagaaagtttacgttgttaacgagattcttagtaagaccgatcaaattaatttgcggaagcgggtattacaagacgtttttaaagttaattttacaggcgtttcagcggatgatctcatttctgtaattcgtaaatatgccgcaattaacaatgaacagcgtttaaaggatgcgttgaacggattattaattagcgatgagcgggtacgccccactgaagcgactagcaaaaacggtttaatcgaacaattggatcgtggattggtaacggttagaaaggccggtgcttggacagatgtgctcaaccaagcttgtgaggtgctggttcatcgtggaattgtcgaccaaaagtatcaaaatgcgttactgcgtgagtattatgatcagccaaattacgttgttttaaatcaaaatattattctgccacacctggatccggatatatatacgcaaaaattaggggtcagttttgtcattattcgtaacggaacgacgtattcttcaagacgcgtaaaaattgtggtgttgcttgccacaccggataaggttagccatttgaacatactatatgatatcaatcgaattgctcaggataaccagtttgtcaaagaattgacgaacttagaacaaccagaagaagttttacaagcattgactaattttttagaaccagaatagcttgatttgaattgaaaggggagaaattcatgctcgaagattacgtgaaacctgatacggtatttttacagcttaatgtaaaaaatcgaaacgaattatttgcattgattgcaaaggatttgtttaaaaaaggttatgtaaaggaaggttttctagattttttgacacatcgtgaggacaattatccaacaggtcttcgactagagtctggagcagttgccattccacatggagatccaaagtttatcaagaaaccatttgtcgcggttgtgacactagaacagccaattgttatgcaacgcatggacgatagtaatcaaaatctaccagtcgatgaattgtttgtattgggattggatagtggtactggtcatattgaattgctccaaaccattattaagttgattcaacaaggcagcttcgttgatcagattcaagctactaaaaatgaagaacaagtcttacaagttattgcggaaactgaagccgcagaaaaataggaggaaaaaattatggcaaaacgtgtacggattattgttgcttgtggaagtggtgttgcaacttcaacgttagcatcacaagacgttatctcagtggcagaggaatatggtgttgattataccttgaataaatgcagcatggtgcaattaccttcaatgagtcaaacagcggaccttgttttgacgaccaataactataaaggcgatttagatacaccacatatgagtgttatgggctttgtaacgggaattgggaaggacaagttgcggcaaactttaggtgataaattagtggaaattgcaaatagctaacagggggtcacgacatggacactttacttcatatcgttagaactattaccagtatgggtgcttctgcaattttgccgattgtcatcacgattttaggcctggtttttcgtatgaaactgggagcagcaattaagtctggtttaacagtcggagttggatttgttggattaacgttagtagttaatttgttaaacgattccttgaagccggcggttaattactatgccaagttaggtagtggctttactgtttcagatattggatggccagcagtaggtgctgccgcatgggtagttccgttcgcagcattgatgattccgattggcttattggtaaacgttgcgctagtgcgcttaaagtggaccaaaacacttaatattgatatttggaattatatgcatttcctagtgccaggggcttttgcgtattacttgttccatagcttttggattggtttagcagtttcagttgctttgtcgatcttagcattgtttgtaggtgactggattgcaccaaaatggcaggaacagtacggcctggaagggacgacgaccacgacgatcattcatactgcatggaccttgccagtaactgttctaattaataaaattattgattttatcccaggccttaataaattggatgttagcttggataagttgaataaacgtattggtgtttttggtgaaccagttgtcattggagctatcgtgggtgccttacttggttttctctctaaacagccagttactaaaattgtcccaatggccatgggaattgccggcgtaatgatcttgatgccaaaagtagttggcgtgatgatggaaggtttgtcaccgattggcgattcagctaagaactttatgactaaacaaatgggtgaaaataccgacttaaatattgggatggacattgcccttggtttgggtgatccagcaacggttacaacaacagttatttcaattccaattatcgttgtctttgcactcttcttgcccgggattcgtttattcccggttgggttgctgatgtcagtcacatatatctcggttatggccgtcttagcaagtaagggcaacctattacgctcgattatttcgaccgtgattttcagtattattgttatttatctggaaggctgggttgctccgggagccactgcaatgttaaaaggtgccggaactggtctaagtggtcaaggttcagactttgtcttaaccggaccatgggaattattaacttattggttatcaactattttttaaaacttttggatagaagaggagtaatcacatgactcagattttaccatcaatttttggtgcggatattttaaatttacaaaatgaaatcgttttcttggagaaagaagatactaaaattctccatgtggacatgatggatggcaattttgtttctaatattgcttttggcccaaatcagatcaaagcgatgaaagctgcttcagtaatgacttttgatatccatatgatgcttgcccatccagaggaacatttacaagctgctttggatactggggcagagatgttatccgtacattatgaatcaacgccacacgtacattgggtcttacagcaaattcgcaaagctggtcgtaaagcgggaattgtgcttaatccaggaacaccagagaacgccttaaaatatttattggatgatattgattacgttttggttatgtcaattaatcccggacgtccaggtcaatctttcttaccaggtacgattgaaaaaattaagaatgttaagcagatgattggcaatcgtccaattcaaattgaagtggatggcggaattgatgataagcatgcgaaagacgcaaaacgggttggcgcggatctattagttgttggtggtttcttgttttccgatgacccgcatgcacaatatgcgaaattaaatgcggctattaagtagttgggaggctaaatcatgactgaaaattatacaatcaaaattttaaaagaactaagtgatgcagcgcctaaaatcagttccgaagacttgaaacaaatggtggaccagattgtggcagctaagcatatctttttggcgggtgctggtcgatctggtgttgcaatccaggcttttaccaatcgattattacatttgggttttgatgtaagcgttattggagaaatctcgagtcctcattcacatccgggtgacttattgattatctgttcaggatcaggtgaaacggcgagtttaaagaatttagcgaagtctgcaaaagacgctaatgttcggattgcgttattaacgactaagccggactcaacaattggtaaattggcggatagtgtcgtgcagttaccaggtaagtctaaaacagataaaactgatcccgatgttttttcacaaccgatggggtctgaatttgaacagttagcatttctgacgtttgatggcatcgttatgaacttaatggacgttacgggtgaaacctcggaaacgatgtttgcccggcacgcagattttgaatagtgaaaggaagaaaatataatgagtgaatttactggaaaagttgttttagttacgggtgctggtaatggtattggaaaaggcattgccgaaaaatttgctaaacacggcgccaatattgtggtggttgattataacgaagaagcagggcaaaaaagtgctaatgagttaactaaaaaataccaaaaagccatttttgttcaggctgatgtttcagacccggaggcttctgtacggatgcgagaaaaaacttttgaagcgtttgggcgaattgacaccatcgttttagatgccggaattgcctatcacgatactgtggatcaaattagtattgaagaatggaatcgggtattagcaactaacttgagtggtttcttctatacagtaaaagccttctacaatgatttcttaactaataagggttcaatggtattcatctcatctggttctgctcttactggtaccggtggtggtgttgcctatcctgcatctaaagcgggtggcgaaggactcatgcgtggcttggctaaggaacttggtcctaagggtgtcaatgtcaacgcgattgccccacgggtgattgaatctggcttgctgactgttaactatccgactaaagagagtcaaaagaagcttatcgaccaaatcgcagttcgtcgttttggacaggttgcggatgttgctaatgccgcttatttcttggcggatcctgataactcttatattcaaggtcaaactattttacttgatgggaaccgttcaattcgctaaacaatgtaaatctcaaaaaacacttagtcaacaattggctaagtgttttttgagatttacataaagcaatgggtaagaacggataagttaaataatttcgatgcgattttctagtgaatgcttcatctcagcatcgatagaattattagtgaccaatccagtgagcttgttccagggagctaattgatagatgctggttgtcgtgaacttacttgtatcagccaaaatatactgttttcgagattgttcaaaaatagttgaatcaattgaagcatctgaataggaaggtgaggtcggaccattaaaaccgttaaaaccatcagagccaacaaaacacaggtcgacgttaacggaacgaataagatcatttgtccatccaccgtatacggacgaacttttaggtcgaatcttaccaccaaataaatatacttcgttttcagagcttaacagataagtggcggcaggaatagagtccgtgaaaatttttaaatcattgcgtaaaatcagtagcttggccagctcaagaacagtgcttccagttgcaatgatgaccgaagcaccttcaggaattaatttggttgccttttcagcgatttcttgttttaaatcaatatttttttcttggcgaacattaaatgggttttcaactgttttttgctttaatacggcgccaccgtgactttttatcaataagccttgtttttctagttgtgctaaatctttacgaattgtttcgtaagtaacggaatatttatttgccaagtcgtggaccgttacgctaccttttttgagagcatcttctaaaatctgctctctacgttcatccattaaaaccatgttttcatttctccaatttttttatttaaagcaagcttagcataataattggtgtttttaaaggaacaagcgggttttagtttgcttttgttggcattaattgtaaaataaaacgctttaatctattgacaacaactaaaaccaattatatacttggctttgttagaaaataacaaatgaaaatgttggaggttattaattatggataaacgaattgcgcttgcatgtgataacgtcggttttgaacgtaaagaagctatcaaaaagtatttaattgaagaaaaaggattcgatgttgtttatgatccagttaaagttgaagctgatggggttaatacgtttgctaaattggcagatgaaatggcagaagttattcaacgcgataagtgtcgcttaggaatctatatttgtggaaccgggattggttttactactcaggtcaataaacactggggtattcgtgcaaccgctgtaactaacccgtattctgctaaacgggcacggttaagtaataatgttcagattattggcttaggtgctcgagttaacggtcttccatatatggaaatggtggttgatgggtttgttgatgaaggttttgattttgaaaatgcgcgtcctaattcagtaaagaacctacttgaagccaaaaaggatgacgatcggtcattagtaaagcctgattatgttgcatggaacatggggtttgagccagataaagcgggtgaataattatggaactcgtaactcaatttatcaacgatctgggtaacttcatttttattccagttatcttcttagtactgatgaagttgttgggacgttcttggggagagtctttctcctcggcaatgaaagtcggaatcggctttattgccttgacgatggttattagttttatgcttgataaaatgcaaccggcaattaccggtttggccaagagtacgggctcatcgctatcagcaatcgatgtcgggggagcggcaactgctgttatgggatttggttctaatatcggggccgtggttatcccgctttgtgttggcgtaaatatcattttgctattattaaaagttaccgattgtatcaatgtggatgtctttaatttgcatcaaaatgcttctatgggtgcaattgtatacgctttctcaggtagctttttatacggtattttaaccgctgcactgttccatgtttgggccttgattggtgcagacttgggtgcaaagaagaataatgaattcttcagtttgccaaaaggtgtctccatctcccatccagtcgcaaatacgtatttaatttttgcgtacccgtttaactggatttttgatcacattccaggattgcgtcattggaatatgacggcgaaaacgattcaaaaacgtttcggcgttttaggtgatcccacgacggttgggtttatcattggtattttacttggactgtttggctatggttgggaaaatccatacatgacgatcattaagagcttgcaactgggtatgtatttggctgctgttatgcttctcctaccgaagatgacgtcaatcatgatggaaggtttagttccactttcaaacgccgttcgtaaaaagatggttaaacgttttccaaatcgaaacattacggttggtatggatacagcattgattgtcggtaatccggcagtaattgcgccagcgctattgctgattccagtaatggtcgtgttagccgttattttacctggtaataaagtaatgccacttggtgatttatcacaatttgtgttctttattgcttgtatggttcctgttttcaaaggaaatatcattcggacatggttagcgtcaatcatggtatttgcgcccggcctatacattgcatcttggatggcaaagccgacaacggaagtctttatgaagttcggtgctggtgccaaaaagggcgtgatgtattcgtcacttaatccatctgcaaatccgtttacggcgttgtttgcctgggcttcccaaattggactgatcgcatatatcctgattggcgcattattaatttcgattgggtattatttaaagaagcgtgaacgtgttcaagaagcaaaagaaaaagttgctgaaggttaatctagattaggagttgtttctaatgaaaaaagtattagtagtttgtggtaatggcattgcatcatcttcgattatgatggcgggtcttaaggattatttagatgatcagaatattgaagtcaacttggaaaaggcctcattaatggactgcacgacggataagtttaatagtaaagacttgattgtgtcatcaacaaagttagataaccctgatattacgactaaagtaattgtgggatcggcacttttaaccggtattggtgaagatgaggtcttaagtgaaattaaacaagtgctagttgcctaggtgaatatcaatggatatggatatttttgcaacagaaggtcagacagatgttaagacgtatcaggatgccatccttttggcaggaaagatattgttagaacatgatgccgtggatgaagcgtttagtcgggcttgcattgaccgggaaactaactttccaacgggactatttttgaatgagcaattgggaattgctattccacatgcttcatccaagttagtgaaacgtagtacgattagttttgtgagactaagggagccagtcagttttggccggatggaagatgccaatcaaaaagtaaggtgtaattatctctttaacttagccttggctgatggtaaccaacatttaacaatgttacgacaattgatgagattgtttccaaaacaggaatttattgattcaatcagtaagctgcccattaaagagcttccagagtatttaatcaatcaattctaaatagaatttaaagcaggcgattggaagcgcttgctttttattgggaattttacgagaaatacacgaggagagtgtggcatgaaaattaaatcaattattaatgaaattagtgaagtgcccgtaacgattaccgataatcaagtagatcagttttgcaatttgttgaataatacgcggcatgtatttgtttcaggtgccggccgatctggtttgatgatcaaagcgtttgcaaatagattattgcaactagggtatccagtgagtgtgattggcgaggttacagcgccacatacgcataataaagatgttattatctttaacaccgcttctggtcggtcacaaaatttattaatacaagcaaaagaagcggtagcaacgggtgtttatattatcgtagttacgactaatcctagttctgaattagccaagctggcaaacttggttctacacatacctgctcaaagtaaagtttctgatggtgagtctattcaaccaatgggggccttatttgaacaatactcattgctattctttgacagtctagttcttgaattaatgaaatcacgtgatgttaatgaacagaccatgcgggataatcatgcgaatattgaataagatggggtatgcaaggatacaatataaagtaattctgtttgtttaactgaagtgagcttttttagtttggatttatgccaacttggaaagtttactttagcatgctattaaatgcggttgagtggtcgtaaaagtgataggaacaggttaaacttgtgatgcccaaaggtcagcgcctcgacaagatgctggttagtgacaatgatgataaggttaataatttgcgagttaaaaaggacggtgtattgcatttactagtaccgcctaaatagtagaagaatatattcctcaaagaatagaaattgctgaaatatatccaaagctgagcagtcagtccaagcttttgataaaaagttatgttgtggtcaacggatgtaactaatgtaaaggtgggtcaagaaacaaggtatcgattaatgactaagcccccgaagccgcttacgttgactgaaaagataagtgaaatcagtgtagcaacagatagcttaaaaaatcaaagtgcctatgaggtctattcggttgttaaagtaaataaatctgaaatcaagaatttgcgctatgaccttcagggtacggtctattatattactggtagtaagacgtattttgaatacttctatgataaaattcgtggtgtgaataataattaaaaaatcagtgccagccagagatttttatctttggattagctctgatttttttaactcgaccatctgattgtacctaatgtcagccattctttttctgtaaaaatagttctgataacatgccgtaaaagcaggtaccaagaataaagatggcccaaaatatatcggtagtggattcaaatccatgactgtaatgcatcaggacaggaataaagagaagtaaagaaatccagaatctaaagttacgataaaaatttttttgaaacttaaatttcatttttattgcctccaaaatgttttagcatacactaatgctgatggaaatattagtccaatcattaacgtttaaagagatgttaacgaacgaatcttcacagtgacagttagttgttaaagatttcaaacagcaaaataaattttctttgaagttaagtcgccatttttaatgttcttctatgcttactatttatcagcacttctggatgatttgtatcataatttctattatataaagtacccccttgagttgaagtaaatccagactcaggggggtattatgttttcagctaaaataaagcaacaagttttaagtaaatatctccagggaaattcgtccctgttacttatgaaagaatatggtatcaaaggaagtgcgacgatttatcagtggctcactcaatttgaaatttttggcattcaaggattagagaattgtcgtaggaagacattttatgactattcctttaaaatcaaggttatcaaatggtgacaagaacatcatgcctcatatccaataacggcagcccatttcagattgaagcaactgatgatggtttgggactgggaacgaagactgattgagggacgccttaagccatctaaaggacggtctttaaaaatgacagataaatctaaacaatctaagacattggaacaacttcaggaagaaaacgagcttttacgaatctgggtagcatacttggaaaaactcgaagccttggcacagaaaaaatctcaaaccaagaaaaagccagctaatcactgagctaaggcgtgaattcaattttaaattagttgtggttttaaaagcaacacacatgtcgagtagtagttaccacgatgcgcttcatcgtaaatatcaatcaggctcatcaacgttaatcacaaggcagtacttcgtattatgcgtgaaaataatctcctttgtcagacattcaatcgtcgaacgaagaaatataactcttataaaggaactgttgatacagttgcccataaccgtttaaaccgtcgttttaaaacggatcgcccatttcaaaaaatcgttactgatgtaacggaagtccgttgggggaatcaaacgatcaacgaacgcgcatactttacagcttatattgacctttataacggagaaattcttgaatgggccattggacgcagaccaacggtagactttgtcacacgccccttgaacgattagtggcaagacgctcgggcttaccataccgtatgacaattcattcgggtcaagggtttcagtatcagaactgtcggtacgtgaatattttgcgacaagctcgcgttttccaaagcatgagctgcaaggccacatacctagataatgcggtagctgaaagtatctttcacattcttaaagttggcacggttcacaattagcagcttagaaattcactccaatttatggggttcacttcagttgtgttttttatataaggttactgaaaaaacgaagttagagcggtattcagccgactaattgaatcgagatttttaacaagaatttaagctcaatatctgcggaaaactacaatttcttaataaaggctcttgaaataccagataagaaactagcacacttgatcttatttgtgagtataattgacttatcaggttaacttggaggttgatggcatgcaagtgagtcagtatcaagatttacgtgttcagcgaacaatcaatagtatttacgatgcttttaaacggttaatttgcgaaaaagaatattcaaaaattacagtgaccgaattggctaagatggcccagatcaacaaaaaaacattttatcggtattatccgactttagatgatttactgattgaattacagacgcgatactctcaagcctatctaaaagagattggtaatttgcaatatccacgagatctagcaaaaagtgtggaagcttttttcacctattccgctactcagggtgaggcatatgatcgaattacgacgtgctcagtggggtcttacgttggcattcggcaacaaatgatcaacgaagtcatggctaaaacttggggccagtcccaggagtttaatcagcttgcggattggaaacaaagaattttactagattttgtggagcagacgggactgaaggtttatacaacttgggttgcaactggtaagaaagaaccccttgaagcagttattagcgctgctaccgaattaatgcaaggcggtgtagaacagtatttaaaattagagcagtgagtcaattttcagtttgagtatgagtataagggtcgagattgttaaaaatgggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgctggttcttgataaagcttttaatattggtcattagctgaggactgacattttcgacatgacctagtgctgctttgaaggatcgataatcacgcttttgaaaagccttaactaaggcatgtgcggcttggtaggtttgtcgaaactgttggtctagatttaaaccggctacgactaattgctctggtgtcatgcgatctttaagatgcgcaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattctgatgtgaacggtcttaaagccattcttaaccatggaacgtttgccacaacgtgcgcaaacagtaaccggatacgttagctttgcaagcacttgtaagcttccgttagtagcttcttgaacaactaaatcagtaatatttgggtctttaatttggagcagtactttagtagaatggtctagggacatatctgacactcgctttcaattggttttggtcgacttgattgtagcacaggacgatatgtccttttgttgtacataaaaatagtgttgatggattttatccatcaacactaaatatcatagacccttaaaaatacagtctcggcccttattttgtatattgaaagaattttgacgattttggaagcctactagcgattaatgtgtactctaaggatgtttattacttgattcacgttttaatggacgaaaaaataatcaaattgatatattttatgcgccaaattcagaaaaagtgtggcataagtcccgcttttaaaaatactgcccattttttagtgacggaatccatcgcataatgaatccatcagcaacgaaataacggaggctattaaatgacagttaaaattaatgaagaacgggcagttgctcgtgttgttcaccaacaagttcagggaatgttagaaaaaaatcttgaattgcttgatcaggtaatcgcaccaaatgctaagttagtgcacatcacaggaactgttcaaagcaaggctgaatggctacaacagattagacttggacgcatgcactactttagtagtcatgaggttttgtttcaagtggttgtaaaagggaagcaggcgcaagtagtcatgcgtaacgagttggatgcacgcatctatggattccggaatacgtggcctttgcaatccaaggtcgagttagttaagggaccacacggctggcaaattattgcctcacacgcgtcgatgtattagaaggagaaatgatgacaaaaagaagaatggcaatcgcaacgattgcgttgttaattgcgaattttatgggtggcttagatgctaccattgttaatactgcattaccggcaattaccagtgatttaaatgggattcgcctgattggctggatcagctcaatctttttattagggacagcagttacgacggtcttatggggccgagtgggtgaattgattggtaataagctcaccttccaaatttcggttgtgctatttatcattagttcggtagttggtggtttgtctactagtatggtcatgttaattattgcccgagcctttatgggaattggcgctggtggaatggtttccatcccatttatcatttatgcggacttatatgaaaatcctgctgaacgagcacgagccttgggatgggtcacagcgttttatacgttatccaccgttgtcggtcccttgattggtggctggctcgtagacacattgtcttggcattgggtattctttattaacttacccattggaattatctcactcctgttattgcaattctcttaccgtgagagtgagcatgaagctactcaaaaacgatttgattatttaggatcaggactgttgattgtaaccctgattgttttactgtttgctagtgacgcaatcgcttcaaatttaactcaagcgttggttttactggtaattggtttgatcttaatggttattttttaccaagttgaaaaacggcaaaaaaatgcattggtacccactgaattactgaaaaattggcgtatccaatcgcaaaatgtcatcatgtttctgattaacggtttcttcatcggttatagtgtctacgcaccaatgtggtcacagggactgttaggtactagtgccacgttaggtggtttgacccagattgctggttcgatcctattattggtggggacaaggtatactgctcatttgatggtaaaaatgccgtataaacgaatcgttatgtttggaatccttagtgttttactatcagcattatcgatggtgatggcgacccaatttgcgccttattggtggttattagttagtggtggctttaatggtttgggaatgggcttatcgtttacaccaatgcaagtttcactacaggatggtgttcgacgagatctaattagtgtttcaacaactttcgggttgttattcagaacacttggtcaaacgtttatgtcttcaatttttggtgcgattttgagcattagtactgctagccagattggtgggaaaattacgacacagatgatcaataagttaacggatgcaggttcggcacgctcgttaccacagaacttgttaccgcagctccgcaccattttatttaatggtatgcatttaattatggtgattggtttgattttggtggtcattgcgtttgtaattaatctgactcgcaaagaacctgccaagcaaccacggtaaaatattttaagcgtcggttatgagttaagcgtggcatatgtctcaatttttaaaacattgaccatttttatataagccaattcacgcgataatcaaggtgtaatcaagaaaggaagtcccaaatatgatggatattcaagaagtttcagatcggttagctttaaagcaggttgttgatttattttcaaattactcagacactaaagaaaatgagaagcaggttcaactctttttaccaaacggtaaagtaaatattattaatgatggtaaagttacgtttacgctgaatgggcgtcaggaaattctgaacgctttcagttcttcaatggacgattactcagctgtctttcatatgagtggacaacaaaccgttagtttcacggacgcaacccatgcggatggcattgcttataattacgttacgctggttaaaaccaatgagcaaggccaaacggtgacgactaatgaaggggtccgttatcaggataagtacgaaaaagtcgatggtcagtggtatattgcagaacggaactctaatttcatctggcatacggaggacgtgaaataaatgaaaaaagggttaattattggtgcaaccggatcaattggtagtgccgtacgtaaaatattgttagcaaaaacggacgtacagttgactttatattcgcgccgtgcagaccgattaaagttgatagttgatcgtgaaacggcggtggcagggagtgtcactgatgatgatcaactagatcaagcgattaaaggacaggactttgtttttgtcgcattaagtggtgatatggatagctttgcagctcatattatctcagcgatggaacgcaatggcattcaacgattaatttttattacaacgatgggaatttatcaggaaattccagcgtggttaggtgattcgcctgaaccttaccacaatccgattttaaaatcgtttcggcaggcagctgaccgcattgaacaatcagatttaaactacacaattattcgtcctggttggtacaataacgggccaatcaattatgaaattacgcaaaagggcgaatcattcggtggtcatgacgtttcacgcgatagcattgccgattacgtcatgaaactaattacggaaccagcgctcgacaaccgagctagcgttggaatcaataccccagaataggagcagctaatatgaaaaaagaaatcacattaaataatggtttgaaaatgccagtattaggattcggagtcttccaaatccccgattttgaagaatgtaagcaagcagtcttgactgctttaaaacaaggttaccggttgatcgatacggcagctgcgtatggcaatgaacgagcggtcggcgccgccattcgtgagagtggcatcgcccgtgaagaaatttttgtaacgactaagttatgggtccaagatgcgggttatgagcaaacacaagccgctatccaggcctcacttacacgtcttggacttgattatattgatttatacttgatccaccaaccgttaggcgatgtttatggttcatggcgagcaatggaagctgcttaccacgatggtcaattaaaggcactgggagtggccaactttgaaaatgaccggttacaagatttgattatgcataatgaagtcaaacccacagtcgatcagattgaacttcacccattttatcaacaaccacaacgggttcagtggttattgaatcatgacatcgtaccggaagcctggggcccatttgcagaaggcaagaagggaattctcacaaactcagccattcaagaaattgctgaagcacatggtaagacgaacggtcagattattttgaaatggttgaaccagcgtaatattgtggtgattcctaaatccgtgcatgcagcccgcattgttgagaattctcaaatatttgattttgagttaactcaagacgagatgcaacaaatgacaaaattagacgagagcacgagcctatttggcaacatgcatgatcctgaaacggtagcgcaattgggtggctttaagtttgactattaattggcggtgatacgtaagaaatcaaaaactgcttaagaccaacttgttgactggtgaagtagcgtttaaatctgtattggctgaggagcacgtgataagttcaaattaatgattgatagtgagcacgattactgattctagtcattgtgctttttactgtaaaacgcgtaactatcaacttttcagctaatcgttacgcgtttggcaggcttcgtattattactggatatgaacaggtgtgtttactgggatatgctcgtacatccacttagcatccgaaatggacaagcggacgcaaccatgtgaatcggaccttttgccgagtaaggctgccttgctggcaatatagtgatcggatgcgtctactggaaccgagtgaaagaggtagacgccgtgatccttaaatgagacccagtaattggcaccttcgttcaagctagcattgtaaaaatgcaggccgcgttcaggttggataacgaaatcgcctttgggagttgcatttgcaccgggtttaccggtagtggcaagcattgtgtacaggagcttattgccagctttcaggtagacccgctgttttgcaacggagacatcaatcctcaagttgggataattttgcacattcggataaggatggttggattcagaagggccgtgccaatcaaccggggttgccgttgcagcggctgttttatggctgacactacttttacgcgttttagatttagtatggcttgaattagagtgacttgtactggcagcttgagccctagttgcttcgaaagcgaaactatttctaaccatacttctaatcccaaatagtagcactattccggaaaaagataaggttagatatagaataaactttgttgttagtttcatgtaatcatactccttaattttacattactgcatagcggagggtgccagagccagaaatgtattgtaaccaagtgtaaccgtcagcagtaatctgggcgttataaataacagagtcaccggggtagtagaccccaactattgacgctgacgttgatggtgcagttcggatgttggtttgttgagtaaaaggtaaaagtacccgaaatattgttggtattgtattgtgctgaggtgccactcattgcaacgtaacgcgtattgccagagccggaaagatactgtaaccagatatatccctcagcgttaacttgacctgtgtaagtaactgaatcaccaggatagtaagtaccgacaacgggtgccgatagtgaaggtgcagtccgaatgtttgtgttctcagtaaatgtataagtgccagatacatttctcataggattggttggcgtatatgtcgatgttgacggaatacttatcgtacttggcaaagcaacgtaatggattgcaccggtactagcaagatattataaccaagtatatccttcggctttaatctgacctgtgtaattaaccacgtccccaggataataaacaccaatgataggtgcagataaggatggttctgtccggatattcgaattctgaataaaggtataagtgccggacctgtggttaccggtggttgtagttgtcgaaccagtattgcccgtaaaggcttcttgatcccattcctgcagatcgtaatcttgaatggcattaattaatgaagtggcatagttaggtgccgttgcgtagccatcgttttgcaaatcccatgcaacggtcgaataattttttactccaagcaaattacggtaacgagaattttgattaaggaatgcgccatgatcaacaatactagttgcccagtctgggtattttcgaaaggtagcctcaatcgttacgtcttcgccatttaaatattctgttgttggcatttcaatagaatgaccatgatatgagcctttgattccaaataaattatgaccttgaactgataatgtggattttccccaaccactttcgagtaatgcttgtgctccagaaatggatggtagaatatgatattgtgaccacccaatcattgcaccaggtttaattgcaatgaaaaagttttttacgtaatttggaacaccttgttcaacgtcatcgcgaagtaaagcaacattaggaagtgtgaagcgtaaaaattgacctggtttaaacgaaaatgaactatgtactgtaaatggtcgaacatggatagaattagttgtaacgggtgtcggggatgtgataggggctgaatcatcaataaattgcgtgctatgactaggaatagctggtgctgctaccgttgtcggagtatttgcaatagttgacttgatgttgtcggtgaaactgacattggattttgctggtatatatggtgccgtactggctacggaggtagccgcgctattacttgtagttgctgtctcatttgaatttagcttaccagtagtggatttagatatttgtttgcttgctgtagttgtggaaatattactagtggctgaactggcctgctggctagtagtagttgctgttgaaaattgatgggttgctgaagacacgttagtagcactgttagccgtaattgtactaattgatgatacttctgaggtagcacctgaagttgcggctttaactttagtggtactaggacttgatgtttgatcagctttcccttgtacaggctttgctaatgtaattcctaaaacactgctcattacgacaatagaactgagttcgacaatcttatgactagtgttcttgttatacgtactccatttttcatagaatattcctccaatttctgtgcgataaatgaaaaaatcacaacagccacgtgattatttccacgagttgaatcctagcacctggttattcggatggaaacgtcaaattaaatggatagttgtaagtaaggttcgtcttgatgattatagcgggtgtaaactgacttgcttgggtaactgtggattttttgagactgatacggtgtggaaaaatcatagtcaggaaagtttccaaattaatttagggtcgcagtcttttagggtgggcgctaagtggtagtgatgtgattgttggcagtaaagtggtagccgtgtaggtataataagactaacgaccattgcttgcacctttaacgcgtgactactgaaagtaccaatgttttgtggcgatggcgataaaaacaacggttattagaggttgctcaacgcggacttgctgattggcgaatgtttacgttataagccaaacacaaataaaccagcaaataccaatgtccctgattattcaggacatcggtatttgctggtttttaaattagatgaataacaaaattagttaatcaacatattgcgcgtagtcgatccctagtcgcttggcgattccggtaacttctgcgagtgtcttgtcatcaatctcgatgccgttagctgaccggtcttgatacgcggcagcttccttatcgccggcaacgatgactggtttgccgggaacggatggtaggtcgcgaatggcttgcaagtaagctgaaaacttagcaataatggcatccttatcaccaaagattgaagggtcgatggcgacaaagctctgacaagggcccacggaaaggtcgtccggagtaatttcgttggaggtgttgcccattgaaaggattgctgtgaaaacctcgacgatgacaccgagaccgaaccctttgtggctaccggtgtcttcggtaacgccacctaatggagctaaaccaacattggaatctaaatcacggagggcatccaagtctttggtatcgttatggctattaacgggcgtttcgccatccttagcgacccataatgcgggcatatctttacctaatttacgataaacttcaattttaccttgtggcaccgtcgttgtggccgcgtcgaagataaatgtgttcgggttggctggcatggcaaaggcaattgggttggtgccgaccaatgctttggtagcatgagtgggtaacatcgctgaacgtgaattgcacgacgacaggccaatcagaccttcttcggcagccatgttggcatagtaacctgcaataccatagtgaccggagttacgagtcgtaacgataccgataccgtgttgttttgctttttcaatggctaggcgcatgctatagataccgttcaattgacccaagccaaagtgcgcgtcaacgaccgcactaacatcggtttctttaacaacttctggctgattatgtacgcgaatcttgccgttacgaatgaagtcgtcatacatgatcattcgctggacgccatgggattcaatgccaatcaagtcggtgtagatcaacatgtgggcgacttcttggctttctttttcggtaaagccgtaacctttgtaaatattgtaaatcagttgttcaatttttttgctattgtatcgttttaccattacattcaccacgttatttgaaatagacttaagtgacagccctgtatattataatatgataataataagggctttgaatgtcaattaaattttaataatctgttaatcgtaaactaattaaaagtgtcatcatataacgggtcaacctgagtcttcaaagcgcatggaattgaggtcagactaactcaaagctaatgccgggtcatatggcacggaccaatcataaattaggtataactaaagggggcatcaataaagtgtgccgataactgatggcctgtttagggtggccctcattagtagctggtgatgaattggacgaaataaattgcggctgcgacgttggctgatgctagcgctgagaccgtgaaattgcggtttaggtattgctggtcaatgtgcagactagaatggcaagttgaattatttgcgaatggttgcagttgtagcacgcgtgcttgtggataagttaaaggaattagatgacaaatcggtaattagttgggactaatgactgtaaatgttaataacatgacttatttgtgggtaagtgcatgagtatctggggataagtaaggaaaatgaggataattgtggtgaatccagccatccacagtgcataacttttatgatgtagaagttatcaacagatttattagatatgatgtgaaattaatagatggggattacgtggttagtaataactttttgtaatctgattcaatgaaattctttagtttaggcactggctcaattagaattgttgcgtctatattgatttgaaattctgatatatcaatgattttgagcacctatcaaataaattgttagctatttagctcataaaatgggtaaataagtgtagtcggagggggaagaataaatgggagattcaattggacaacgtattaaagcaaagcgattagaattgaagttaacgcaaaatcaagttgcggaaaaattatttgttacacagcagactgttgctaggtgggaaaatggaaagcatacattaccagtaaaagctgttcaggatttgagtgaactatttgatgtaccaacagcttatttttttggtgaagatcaaattattatgcgtcgatttaatttttttgcatttgttggtagtgtttttgttaactttatcttattttggctaattgcgattgtattattaacagttttattaacagtgtggggtatgctaggtgccggtttggctgcaccagttgtgattatttggcagttcatcactgctgctcatatttttgacattggtcgtttgatgattagttgtggtatgttgctcatgtcgttggttgttattccaattgcttggaaaattacatgttatatcggttgcattttaaaagcctattatcggtataatgtaaattcaattgtgtatgaggtaataccaagggaggctaatgatgattatcgcaaataagattagcaagcaaattcaacttgcggatcatgatgttgagatattgcatgaaacaacgattcacgctaaaactggcgagtttttaagtgttattggtccttctggctcaggaaaaacgactttattgaactgtctatcaggattagtaaaaccaacctctggtgaggtttacattgatggacagtgtatccaaagcttatctgcacaaaaattggcgcaattacggcgcacaacgattagtacgatttttcaatcgtataatttattgccagcgttaaatgttttagacaatgtgatactacccttacgtttgaaccatcaacgaataagcaaagttaacgttgagacgttattaggtgatttaaattttaaggctagtttaagtcagtttcctagccaattatcaggtggagaacagcaaaaggttgcgattgctagaaccctagttatgcatgccaaaattatctttgcagatgaaccaacaggtgctctagactcaatgtccagggaggtaatatttcaacaattacgagagttggctaataatggtgtctgcatcatcatggtaactcatgatattgaacaggcagcccgtactgatcgtgcattaatcctaagcgatggtcacattgtttctgaggtcgaacgcccgtcagttgatcaactctttactcaaatggatagtatacgggggtaatgactatggtgtcattaagtattcatcaatttcaatattcttggaagtcttggatgacgggaaattttatttttattatttctggctggcttattggcttttgcttaactggtatcgatacgttgagctgtgtaacgttttcttcacacattgatccattaccattgtttatcatgccaatggtttttggtggaataacactattatttgttttaggtgaagttattcgactgattatgcaggagttggctaatgaataccagttatgggtggttttaggtgctaatcagcatcaattggcacttttaatcgctgtgcagatggggttgacagctttcctaagtagttgggttggttatagtttatcaatgctaagtataaagccgctatacggattattgcaattttacattggccgcacatggttgccgaacgtggtctttagaccatctgtcaaggttggcctgatgactagtttaattgtagcgggggttgcagttttatctggtctaattaacacacatcgattattgcgacaacaccatagacgaattttcaacatgctcttattcgctatatcgctagtgggattgagcatagcgaattaccaagtgttagtgaccaatacacaagaagataatggaagtgtttttcttgtactattattttggttaattctagtccagactcaaattggcagacaattactgatgtggctttctggacggataacgaagataacaccgtctggactattcaaattagcaagttgccaagtgatgattaatgccaatgttaatgtgccaatactagcattgcaatccctcagttatgggttaatagtgttactttacggacttggtgggactggtggtcaagatattaagaatgtcattgtttcgtttattgtttatgtaggggcaccgggactactagttattgctaatataatttctgttgcgatgttaagcggacgccaacaagagcaaaacttccaacaattagagcaattaggattcagtgctaggatgctgttgcaggaacgtagcttggagtgctgttttcaagttgtaccgctgttaataacggcgatgattacgaatcttacgttgtatggtgcattgctgatgcttgcatggcatacgcaagttaggatacaaatcagtttaatgtcggccttttggctaccgatgggtgtttcaatgctgacatgggtaacgttgacgatggttgcatggaaagaagtttttgttcacttggagagggctgaaacgggtagacaataatttgctgatttgttttcaacagctatatggcaaccttggcgtagtagtcgtataaagcagacctacccatttacgctcaacaggtccatcttgattttgaacaggttggtaatcaaggtaaacgggtaattgtctttgaccaggaaacgaccaatggttagctggttttatcgtgagtggacgcgcctacccgagcagttattaagatactggaagtgggcaatgacaagaatcagcgtgcagccgcgcgctaatctgtcctaaactaatattagtaaagaaataaaataactgtctaatcaaatacgatattatgaacgacgctggccggataatctttagtataatagtgattattagttaacgttgtacgattgattaatcatgaacattaggtggtaaatattatgaatgaatcggcatcggatgaaaactttttggattgtccatttgccagtgttcaaaaagtcgttcgcggaaaatggagcatggttattctgtatttccttagtcagcgggtcttgcgttttggtgaactcaatcgcaaggtttatccaccggtgtcaccaaaggttgaatattcactcaccccattaggagagaagttcttgcctgttttgaaggctttggagaactttgcggtagactatcaggattaccaagcttaattaagtgaaatcggttaagaacgagcatgctccggtttattcacggcactaattgtcgtcataaaaattaaaaaacgagatccagcgacgtcttcatacgtgcttggatctcgtttttaggtagaactaagtgactatcgagcccagagttgggtcgaatggcgatgtcacttggccttgaaccgcataactaaaatgataatattgcttttaaattctgaaagctaatgaacaactcttctttgaaacttttattgggaatattgctttatttaatacgcatgatttatctatccaagaaggtgtctgcattatgcggcagaatttggcgcgagtgttgacgttgttttaactgacaagattagtttttggaaaaacttagccgaacggattaccatatttttgacagtattggtaaaatcctaagcggtatagatcgatagttcgggttagttcttcactagattgaaaatgaattagttgtaaaacggcggcagtaaatgccagtgccgctgtgccgttagctgtgactagattcttgtcgctaatgacttgctgttcatgaaagtcggctgagttttgatagttaggataattgtgccacatcgccagtgaattgccggtatgctgataaccagttaaaaaaccgttttgggctaagtaatctaccgcaccacagattgcgccaactggttttgaggcattgaggtgttgctgaactagtgaatataataatgaattattgatattccaagagttaccaccaattaggattaataagtcaatagttggtaaacaatccagttgatagtcaactttagtggtgaagccaccaattgtcgtaaccaatggtgttgttgaagtcgttttaacttgccagtcagtgctttgatttaattgactagctagataagaagcttcccaatctgcgtattgatctagcattagaaataatgcagttttcatgttgacctccagaggaaaatatattttcagaaccgaatatgttatcctcaattataggaacgtacgttctaaaaagcaagtgcatgattaaatgttggagggcagtaaatgagcaaacaatccgtaattcttgagttaattagaacacatatttgctatacaccacgggtctttcaacgtattaataagaaattagccgttaatttaagcgaagttgaaattaaagatttagtcaatcatattctgatacaaccagatgaaatcaaaaggtgtgggaaaaattattatatccgaagtcgtaaagcgcgggtagaactaacagtcaatgctggtaattatcgcttaattacagccagtaaatacacagaagtcgacggcttttaatcaataaaacagctaaaagtaataaaaatattagtgaatccgtgtggtggttgagtattttggcaatggaaaatgggttttacttggatgatgcagtgaagtgcttcttacgaaataaagcgaaatacttaaaaagttaattaatgttagttgagaataattacaggagtgtagcacactttaaaagcaataaatccccccatcaggctagtatggaaatctagctgatgggggaatttattgtgtgtatatatttggacgtgatttaattacgagccgtcaccgatttgacggattaaacagcttataaaccagtattaattgataactagtttaaattaagcgttgtgtcaaatgtcttataagcgttatcgtcgtcataatcgtcagtatcataactagcatcccattttaggcgaatactagtgatgtctttaacgctggataattttgataaaacaaagtatacgttaccgtcagaatcggtaccactgtttaaatcaccgtcaaaattatcgctatccatgtcggcttcgacttgttgaccgtcgttcgtgctgagtttggcctgggtcggataggctgaaatatcttgcccagcatggatactcatgtgaacttttacgacgccgttaaaatctttcttgtcattaccgctaccgctagtataagtgccgtccgttttgtagaccgtgactttatcgattttaaatgtggatttcgcccagctactgtcggtaaatgaggtactgtaagctttttgatcggcgatatcgatgtcgtcatcgccaatcgtgatactgtcagagtctgaatctgattctgaatctgagtcagagtccgtgctatcactagattcttcactgtcgctatcgctgtaactgtcgtcagagttagttgcagctgacttggaagttgtcgttagagcagcgtccatggcagtatcacgggccgttatgttaatgagagcggcgtatcccaatgtcaataagactagtaggcaccaagtccaccatttgtgtgtccaaggttttggttggctagctaaacggtcgaaacgttttccagctggttcagagcgttggcataggaaaacaatgattaaaatggggccgacaagtggaagcagatagaaccataaataatgcgctgaccgattagagtcgtggagtcgccgcgcactggctgtgaattgcatcactgaagtccaaaccatgagcgctgaaaaaatcaataacagcacggtttgtaaaacattaacgtgtaatgggctgaggataaaagctggataactgtatgctctgataccaagtacgatggttaaaactagggaaattaggaccaaatctaagtaaagccaccaatattgaggcctcgtaatccgttgtgaccaagtaaaggtttgacgcattcctagctttagtgcggtccacatattgacatgttctggttgattaggtgtgttgtgctgctcggaagtaatggtgttctgatcttcagtggaagcgactttgtcctgagttgcgccacaaaaagggcaaaaggtcgcgttagtaggaatcgcttttccacagttaatacaatactttgtttctgacatcgatgttcctcctggagtacttatactaggcgaaatgttatgaatataagtagaattttattatatggccgagtgaatgattatggcagccgaaaacaagcatatcataactagttaaaaatattaacaaaatattaatactaaattcatattttgttcaataatagacttaaatagttatttatttgctttgttgaaagtggcaattctaagcttaagtaaaaagccgtgagctagaattgatcctcggattttgaaatactagatattggtcatgaaaggaagaaaccattaacggtaatcgtcattatgcaaattaattaggtgcagtaatttgtcgacatagtaatcgatgattaagttatagactaaacacgataaaaccccagcgagcttttaacttgctggggtttaacaattaattgattctattcagtgctgcttggggaatgtcttttcgatcaactttttcccagttaatcacttgttggcgtttgtcattataaccgactttgagataagcgtgcatattgagtgagcgtggtaggacgctatcaaaagtgagctctttcttaacaccattgtcgctgtatccaggttgtgagtaatggtagtagacatagggcttgccggaatcatctttcccggttttacgttcacctttagtcgtgatttgagtatagtatgtttttgttccgtaatttgagtggtaccagttgaaaccgagaccaactggtactaatacgataatagtgatgattagtcccaaaattcccgcttttttcattaataatccctccaaatgattaattgaaatctgatattaatcataagagatataagaaacggtggatagcagtttatgcaatgctaaacgaaaaacaagtaattaaatataatattaataatttaatgggattcaaagtctgattcttgcatttcatgataagttgtcatcttctgatgaagaaaatccaagttagcttgtgttgctaccattaggtcattaagttgtgtttcttgtttttgcagtaatatcaaacgttcagggattgtttgattaccgatatagcgcaattgcgcgtagcgttgcatgtttcgaatcgacatgcccgtttgttttaaacgcttcaaaaaattaacccagtcgatatctttagcctggtattgacgatgattaccggcagttcgcgtgggacgaagcaggccgacttcttcataatagcgtaacgtatcgattgttaggtcagtttgtcgtgaaaattcaccaatttgcattaatttgaaaacctcctgaaataaagcttgatgtcgggtacacccgaggttgtaacctagaatcaatcaaatgaaggagctgattaaaatggaaaataagcaacggttaattaatggaaaagccatgttacaacgggtggatgctgaagcagctgatcatgtaatggctagtttggatagggtggcaccggatgtggctaagctaattcttgaatttgcatttaatgatatttatacacgtcctggtttatcgttgcaacaacgcgaacttgttactattactagtttattaacgcaaggtgatacagcagaccagttacgtgttcatctcaacggatgcctcaacgttgggcttagtcgtactgaaattgtggaaacttgcattcattgtattccttacgttggttttccgaaggtattgaatgcgttgacggtggttaaagaggtttttgcgaaaaaagaagacttaagttagtctctgtttaataagccgagattgaaattgaactgtaggtctcttcagtatatttactaatagaaagcgcttcctgaatgtcggatagagcgtataatagtgttatcgagggaactgaatataaatttagtgaagactgctttaaattaacagttgaattatcttatgatcggtaagcaagatgttatttaatcgaatgaggtgaggatatgagtaatatcattcaaacagtttttgggatactactaatcgcacttggctggtttcagattagagcatcgcggcgatatttccgacagctaaagttgcatgggaacgctgaaatgtcggtttttgcgcctttagcattatggagtgcattggtatttggtgcctttttaattgtaggtgggattgtacttacactgggaatatatcactgattctaataagtggaggtacgtaatccgatttctaagagtaatagaatgagttgaaagatccggttaatttttttaaattaaccggatctttttattgaatcctgataaaaaagtgactaaatgctaatcagacgtcattatttgaatatgattatatgatatttgaaaccaaagaatggaaaaatgtgattaatttgtaaatcaacttaaataaagcgtttacaaagactgacttctttgctatcatttagtcattcgaacgacactcattcgaatgactaaatgataagggatgtgatgctatgtcgccacttaaaaacggcagtaatgaggcaacagctaatcggcgtgcattgagcctgactagtatgtactttaatcgttttctagtattccgctatgtaaccgctatctttttctttgttaatctttattgggcgattgttttattcggctttggttccggcattggcctattgccaagcattttgttaattggaatagctgtagtgatggtagagcaaattggtaagttttggaagcatacgaatcggctaacttttacacggtggttttactgggtgcaactctttataaatctgagtgttggattgagtttagtgtttggaaaactaaaagtgttctatccatttttaaatgaagcgagtttgccctgggtacttagtgttttaggctttggtattttggtaagtgctttccttgagtatcgggtgttcttgattgagcatgataaggatcactatattaagcatattcgtcagtttgcagcaagcatataaaggattgggatgtgaaattcgatggatgatacaaataataaaatgtttcagtttttaaataatcacttaatgggcccaatgggaaagctggcccaattcagaattgtacgggctgttatggctgccgggatggcaacaattccgtttacaattgttggatcaatgtttctgattgttagtgtgttaccgcaaagctttccagcactagccggattctttgctgtttcgtttgacaaaatcacaccgttatacatgttagcaaataccgctacgatggggattttatcactttatttctgtttagtttttggttatgaatatacaaaaatccaggcccaagaagaaaagattgaagtgaatccactgaatggggctttgatttcaatgatggcctttttcatgtgtttaccagaattagttttcaagggcggtgccatgacgcttatcaatgttttcaataaaagcgctaaaattattgatggctgggaaatgggcggtggtgttactcgtttaggaacgactggtatttttactgcgattattatgtcgattattgcggttaaaatttatgcaacttgtgttaaacgtaactggacaatcaagatgcctgaaacggtaccagcaggcgtagctcgctcattcactgcattgattccaacagctctaattgcgttgacagtaattgtgattaatggattattaattttgatgggaactgatatttataaaattgttgcgattccattcggattcgtgacgaatttgactaatacttggattggtttactggttgtttactttattatgcatgcactctggttggttggcattcatggggccactattgtaacctcatttttaacgccaattgtattatctaatatggttagcaatgctaaaggtgctaatattccgtttgcgggcgagtttaacaactgttttgtgacaatcggtggttccggtgcgacacttggaatggtagtgtttatcgctttctttgccaaatcagctcaattgggcgcacttggtaaagctagtattgtacctgcatttttcaatattaatgaacctattttattcgggatgcctgttgtttataatccctacactgcaattccgttcttcttagcaccaatgtcatcaatgtcagttgcttattttgcaatcaagttccatatggtcaatccaccaattgctcaagtagcatggccgacaccggtgggcttgtctgggttcttaggttctggcggtgattggcgggcagctgttttagcagttgtctgtgctttgattgcttttgttatttggttcccattcattaagttttatgacaataaactttttgtacaagaacaaagtggaacggtgcaagccgattaatgattatggcaagttataagtttgattcgcaatttggcttttaagagaggaaaaattatcatgagtaaattaccaaatggattcttgtggggtggtgcggtcgctgctcatcagtttgagggtggctggaacaaaggcggcaaggggttaagcattgctgacgtcatgactgcgggaagtaatacacaagcacgtgagattacagatggattggtccctggaaaaaactatccaaatcacgaggcgattgatttttatgatcattttcatgaagatgtgcagttgtttgcagatttgggcttaaagtgttttcggacaagcattgcttggacacggatttttccgaacggtgatgaaaatgagccgaatgaagcaggcttaaagttttatgatgatttatttgatgacttgctagcacatggtattgaacctgtaattacgttgtcccattttgaaatgccctatcatttagtaaaagaatatggtggttggcgtaaccgtgagatgattcgcttttttgttaaatttgcacgggtcgtactcgagcgataccgtaacaaagtcaaatattggatgacttttaatgaaattaataatcagacgggtttaaatgagtggggactatttacgaattctggtattaagattactgctgatgaagatgctgaaaaattaatgtatcaggctgcacattacgagacggtcgctagcgcattagttgttaagatgggccatgaaatcaatccagaatttaaaattggatgtatgatggcgatggggccaacctatcccgcaactcccgcaccacaggatgtgatgaaagcggaacgtaccatgcaagctggttattggttggcagatattcaatgtaaaggaaagtatcctaattggttaaaacggtactttgaacgccaccattttgctttagacataactgaggccgacttgaatattttggctgttggaacggttgattatattggcttttcctactatgcatcacatgtgactaaaacaacggataatgaaccagacgattatatgacgcctggtcaaaatcctgaagtgaaaaacccggccttggaacgttcggattggggttgggagattgatccggttggcttacgatacgcacttaactggtttagtgatcgttatgatttaccattgtttattgtagaaaatgggctgggcgcttttgacaaaaaggacgcggatggtaaaattcatgatgactaccgcattgattacctgagaaaacatattgaacagatggagttggctgtcgatgttgatggggttcaattgatggggtatacgccatggggcttcattgatttggtttccgcagggactggacaaatggataagcggtatgggctgatttatgtggataaaaatgatgcaggtgttggaactttgaaacgtgaaaagaagttatcgtttgactggttcaagaaagtgatagctacaaacggtgctgacctctcttaatacgctataataaacatatatgaacgtgctccgaagatttggggtgcgtttttcgggtcatgaaagagggggatttgaaatggcacatctggatataggtcagttggttcaacggattttagctgacattcaggttggtaagttggcggatggacaacgtaaattacctgccgaaccagtcttaatggaaaggtatcaagtaacccgttatacattgcgccaagcgttaaagcagcttagcaacatgggttatacttatcaaatgcatggtatcggaacattcgtccgacagcaacagactaataattcaatagctttacaacatgatggtggactatcagaagctgctgcgcgtgcaggattgaaacttgcaactaagaaggcagtgatggcgatgactactgttgctgatgctgagttcttaccggaagcaggtcatcttaaagataatgaggaattaattgatattcggcgttttcgagaattggatggtcaaccatatttgatggaacattcgtactatataaaagcaatcgtagatacgattcctgaagaagcattgtatggttcattgttcaattattttgaacaacaacgagacgtcaatattggctttattgatcaattactgatgagtgagccactaccagaaattgccggggagtttatgaatctagcaaatggggcacccagtctagtagttaaggatgaaacatatttaactaccggaaagatgttggcattttcaaagcaatattatgattatcgacgagcacggttatttatggttaagaagattcgttaggtgttggggtgatggccctattattgaagttagtaactaattacttggataaaataaatcggtaagcttataagcctaccgattttttaatattattttattcatcaatttccggagccgacccaagctctgcctgaatcatccagattttcttttcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcattagattgatctcctttcgatatggttattataacttagtggtagcttaatctgaaacgttatacactggcaaattaagttatttatagcccgtagaattaagtcgttttgaaaagatgggagcgttatatggtggtaattagtgctaacaaaaacgaccaccgtatgggtggccgtttgggtatcttaatcagtgtcgaattagacctattcccgtttcttgaacttagctgccagtcctagccaacctaatccagtaaataaggcagccaggataccacccagtgttgcgccgtgttcagattgttcactggtttgcggtaattgacccgaattgtgcgtagcaactgttgctggtgcttgctgttttcctggttgagccagggcactgactggtgcaattggtgttggctgtggactagtcgttggcgacgattgtgaagtcgtagtgccttgtgacacgggcgcttttgccagcaatgaactctctggctgtggtgccgggtttggctgcggcaccgggctcggttgtggtgccgggtttggttgtggtgccgggtttggttgtggtgccgggctcggttgaggtgtagggctcggttgcggcgttggttcaggctgaggtgctggtgtcggctgtggttcgggcacaggttctggttccggacccggcgtcggttgttcaggcccactcggctccggcgtgtaagtgtaaacgacgtgctgggcggtggtgccaaaggtcccgatcgttggaccgacaactttgttgaagacgtagcctggaattgacaactgttcagtttgataattttgaccaaagtcaccacttaaaacaatatccgcgtgaagtggctttccatccgcatcttgataactaacggtgacgggcagtactgcttgtttttcatagacgtaaaggacatgctgcggttccttggtaaagctaccggtcgcgttagttggtgtcttgatgagttgatagcctggaatctctagcgctttagtctcatacgctgcgccgatttcaccagtgtgggtgatatcaggttgtaaggttttaccatcttcgtcttgataactgacagtcaccggctgtggaatctgcttggtatagatgtaggtgacttgttgcggttccttggtaaaggtaccagttgcgttgccgatagtcttaactaagtcgtagtctggaatctctagcgccttagtctcatatgctgcgccgatttcaccagtgtgggtgatatcaggttgtaaggctttgccatcttcgtcttgatagctggcagtcaccggctgtgggacttgttttgtataaatgtagataatgtgctgtggttcagctgtaaacgtaccggccgcgttgtcaggtgtttttgtgagatcgtagcccgcgatttcgagcggcttggtcgtgtatggatcaccagccaaaccgttgcaagtcgtgtctggctgcagggtctttccttgttcatcctgatagctgaccgtcacaggggctccagctgttttatcataaacgtaagtgaccgcttgcggttccgcactgaaagtaccttgtggggcgccttgggtctcgacgtgggtgtagttcgtaatatcagccggggtgctttgataatcttcaccaacgaggccggtcaattcttccgagtcacgcagagcggcaccgttacgatcgacatggtgaatggttactggggccgctttggctgctaatacataaggctgaaagacatggaacaccggtgaactgccatctgagccttgagcaaccaaataaaagtttttatcatttgggacaacgttgatgctgacgccgttagtgacgaactgaccgttggcatcaccagtgaagcctggaatctgtggtactaactgattgaatgtcaacccaccttgaccgtcgggtaccacgttactcaggtcaccattcacggcttttcccgcgccgttgaagtagaaccggtagtagaattggccgttaggagttagttgaactggtttcaaaatggcggcttgcgatttaaggacagcttgctgcccgtttggtaaatagaagcggttctttaaggttgcactggtcgtgtcttgatcgacataaacgagtggttctagaattgtctgcccaagataagtagttgtcttgaggttcggtaagtctttgaagactgacaaatcagcaatatggttgtaagcgacgtccaattcttgtaggtttgtcaaatgcgcaatcggcgataaatcactgacacggttatgctgaatattcagcacagttaatttggtcagaccagccaatggtgaaatatcagtcacgtcgccgttataatagccgccaagtgcgttgagaccgttattgagccaaatggttttcaggttcgtcgcatattgcagcccttccaaggagtatggtgtgtgaccatcaatataagtgttttctccatagaattgggttaataattgcatatcatctttagtaatatcgttaacagatttaaactgatggtcggggagtttcaaagcttgtaactcgcgtaaaacggcttcttgaaggtgcttgttcggcatccaagtatcaatagattcaattggcgtcgtcgctgcggccggcacgactgtaccaacactagtcgcgggcttttcagctgtcgttgccgctgaagcagcttctgcgctagcttgctcggcatattcggaataggtactggaagctaagctattaatagcactggtaatttgaaaagtagtcgctgccgaagtcgcggtgctagcgggaacagtcgcatgcgaagtgtcaggtgttgcggcgctttcggcactagcagcactagcgtcggcggaatacgtgctggcagtgatactattgacggcgctggttatcacgctagccgaggcggcgcttgccgcactagctgccatcttagcaccactagtgggcgcagacgaactgctcgaaatggcactcgtcattggatgaataacctctgaaccgtcagatatctggcttgtacttggagtgcttgctacggctgatttttctgagctagtctcactggaagtcgaaagcggcattgactcggcagcactatcagttgtaatcacactagtaggagccgtgctgttagctaccgtactattagtggcgcctggcgcagcggcactagccgtcttggtggttgtcatactggcgactgaagttggtatgagtatacttgcagagctagcaggggtcgttgaatgagttacactagaaccgtcaatttgctggattgtactcatagttttgttaggtgtactattttcagcactagttagattggaactagcattaggcgttgcagttgtgtctgttggatacttagtggtcgtagagctggccatggctgccgaagttggggtcaggttattggtgcttgcgacctcggtcacacttgaactaggttcggcagcgtgaccacttgtcgctgaagtgctagccattgctgacattaatgagccactagcagccgttgatttcgcgggcagtgctgcggtactggttgctgcagggctactggttgtagtgctgccagttgcgctactaccagttgtcgatgttaaggtaacttgactgccggatagcgggttagtcggcgctgtttgctgaacagtaggcgcagtggtggtgggtgctgttgtcgaatcagtggccgcaaaggcgtcttgattggtcaaaataatgccggccaaaatcgtggccgcaatcccagtaattaagtgccactttggtgggttattagtgataatttttcgcttgttcaaaataatcatactccttttgatgattgatttagtcataagcacactaaattagttaaagtgtagcaccattatttttgcgggtctagccagtttggtggacgtcttgtcacttagttgtgaatggctggatgccggtgcttttcaaaatcatgaaacaaaccgttatttgacggtacttaacgccgatgttgagctgagttagaacggatggacattaagaagtgcacgcttttagcgctgaaatgcttgtttttttaaagtttggtggctcgcagcgacaagttggtaaacttgcctaagaatggccctcaagtcaggagctaccgattaactcgcgagattgcggcgaaattggtagtcactaaactgcccatcagcgtatcaatgtgaagacagcgtaaaacgacctttccggataaattctgggaaggtcgttataggtttataaataaggaattaatgactaacgattgactgctggtgcgtgtattgcgccgcgtgccgaccggaattgcgtccagagtagaaggcgtagccaacacaggttccaggcatgttaggaccatacgtatcaccagttagtccagcggcgtcgttgccagcagcgtatagaccggtgatcggctgaccagtagtgtctaaaacttcattattagtggttactttgagaccgcccatggtacaaaaggcaccaacattgagttcaaagccgtaaaatggaccttgggcaactttaacgagatattcaggattcttgccgaaatcatcgtcttgaccattatcacaatattggttgtaagtttgaatggaatgggtgacttgatcaacaggtaggtgcattttggtcgccagtgcttcaatcgtattggctttaaaaataaatggtttattggcggccacggctacatcgatttcagcctggagtttcgtcattttttcgccccgccgaacgtaaacacctaagcccatgaagttcccgtcctgagccattttgttgatcacaccttggtcgagaatgctgaatacttggttttgggtgtagagcgcgttgccggcgtatgagaagttataaacgacagcttcatcgacaaatcgttccccatgttcgtttagccagagcaacggttgctggccggccgctgtttccatctgggaggccatgtacttaaaggaaggttcgctcggatctttgaggtaaccgccaaagagcatcgccatccccgtgccatattgttgtgcaccggcttgccacgctagccgaagaccgtcaccagttcctttacctgaactaactggaattaagcggcgcgtgtcatagtgggtcagtttctgcatcatgtcgggattattgaggtaaccaccggtagcaagaatgactgcggccgtattgatgacttgggtctcattagtggcggcactttgaatcgttacaccggtaattgcaccgtcagtggcttgatgtagcgtggtggcggtcgtggaagtcagtagttcgacacccagcttttgtgcttgtggttgtaaagcgtcatgtaagacggcttggcccattcctttataaatatgccacgtggcttcgccggcacccattgcttgtacgccttcgtattcgacaccttgatctttaagccattgcaccgtgttggcgctatcgtccaagtaacgacgccagattcgagaatcagcgcgatatttagaatagtcgacttcttcttttaaaacgtcagtggcggaaacgttgatgttttgggccttttgtaagtatgagtcgacggcaaagagaccctcagtgtaattgctgctaccgccagtatggcgtcctttttcgagtaataacacggacgcgccgtgttgtgcgccttctagggctgccgctgttcctgctgctccggtaccaacgacgacaatatcgtatgaatcatgttttgctaacgtcatgtcaattcctccaaactgatttgttatctaatgagcatttgacggctaaattcaccattactataatgaagtaaccgctatcacaccctcatcataacgggggtatggtggttagcaaacagacaatttggttcggcaggcgaatcaatcgtgcggatggagttgaaaaaatggatcttgaccggctacagacgttcttaaaagttgttcagtatggtagttttcagcaagtggctgcccgtgaatatcgttcacagcggacagtatcaaagcaaatgacccagttagaaaatgaattgaaagtgacgttatttgaccgtggacagaacagaattcaattgactcctcaggggcggttattttgggcatctgctcaggatattgtgaacaactatacgacggccttgacggagttacgtcaatttaatgttcctactgatcaaatcttacgagtcggttatttctcagcctttgagcagcggctcctattaccggccttatacgatttaaagcaacagcattcggagctgcaactcgttgttcgccaaggtagtaacgagcatctggcgcagcaagtagctgatggttcacttgatttagcactatcgattaattatggccgtcccgccgttactccagaatcacagttaaccgctgtcccaatttatcataatcaaatggtgattggggtgagccggctaaatccactgagtcggttgtcacaattgccaccgagtgcgttggcgactttgcccattttatattacagtccagaaagctcaacatttttattagaaagttttttggctagtgccccgtttattcaagactatgagcagattcggcgagtatctagtgcagagcagatgcacttgttagttgcgttgaaccaagctttggcattctatcctgcggggttagtgccaactaagcatgatgaacaagtcgcgtatttgccgattacggatgctgcgcaacaaggctatgacatcgtggcgttattaaaatcaaaccggtcccggccgttgatagccaaattggtacagcggttaaaggcgaacgcgaaatctgacgagtagaagattaacctcacagtgagaaggtactgatacggtgagcttgcttaagtaaaaggaccggctgagattgcaggcctgtaaaaattcagtgactccgttataataaaaccattgttctcaaactaatgaatttatacaggaaagtgggcccaacatgtttcaagatattcaaccacacgttttaaaaaatcagaatgatcagcagcgggcaccccggtcgggcgattatatcttaattggtcgtcaacaacaggtgcttttaatgaatggaaccttgcccaagtacgaagatatcgatgcggattacgcgtttagtcctgaccagtatcagtatttgctggctgtcgatcaggcggcctttttctgggtcgatgttgatgcggttgcgaatgataactataccgttggcaccactcgagggttccgagacctaacaccggcctggttggctttcagtagtgcgacggctgcccatttggcttggtggtatgatacgaagcggttctgcgggcattgcggccaaccattacatccgggtgctacggaacggtcactggtgtgcgcagcgtgtggtcagacgatttatccgacgattatgcctgcaatcattgttggcgtgacgaatggtgataagattttgatgaccaagtttttatccggctacaatcatttttcactgatttcaggttataccgaaatcggtgagacctttgaagataccgttcgccgggaagtctttgaagaagtcggccttgaagttcataatattcggtacttcggtagccaaccgtgggcgccatcgcactccttactggccggctattttgcggaccttaatgagaacgtggcaattgagctagagacggacgaactatcgaaagccaaatggttccagcgtgaccaaattcctcataatgatacgaacacgagcctgacatggacgatgattgaagcatttcggcatcatcaggagaagtagaattatgctacattataccgaaaattaaacggaagtttttaataagatagcgtactgagaattgaaagctaaattcttggtacgctattttgatgtgatggtcgagtctaaggcgactttcctacaaataaccattatttaaaacgatggtagtgacgatacaagcagttatttagtgggctatgagatcatagcttgaagtcaattaatgatagtgtcataaagtgtggttactttacaagatgggctaaactgataataatcaatattagttatattaattaaaaaagggtgaagcagaatggcactacttatttcgactggtgtgttagtggttgcggcaatggttagtattgtaattaaccgtcgttggctcccacgactatcggtcaactatgtgagcatgtttattggagcggggattgcggttatcccgttcttaaatggccttatcgaaaagttcaattcagatatttttattggactgattgtagcaccattattatattttgaaggccagaatacgcggctgaatttagttggtcgtcacttacgagaaattgtgagtcttacagttggcatggtgattttatgtgcagtcatggctggactcggcactagcctgctagcgggtgttggactaccattagcctttatcttggctgctatcagtacaccaactgacgcaacggctactgagtcggtgacgatgggccgggtgctaccgcagcgtgaacagactagtttgaaattagaatcattgtttaatgatgcttcgggaatcattctgctaaacatggctattctgtggtatgttaacggttatattaattattcgcagaccttatgggatttcgtctatgcagctggtggagggattgcttttggtggtcttgtaagcggcttaattgtttatattcgacaattaatgttgcgctctaaacttaattttattaataacacgtataataatggtactccgttaaaagtgatttatttaatgacaccatttgtgttgtactttggtgctgaagcacttggtgtttccggtatcattgctgttgtatttgcgggattagttcataatgctgaaggggagcggagtgcattagccaatcctcagctcgccagtgatatttatcaattaattggcctattgagcgatattttaaatagtgtggtctttattgtattgggaattatgttattgcggaccgcgttggatcattccgtctcttataatggatcactgatctggattgtaattggtgttattttatacgtggccaatctgttagcacgttatggttacgttcgacttattcatcatgtccctaatcgagaagcgtgggtatttgctttggggggcattcatggtgctgtgacgtttgcgttggcctttaccgttgcggaaactcaagttaaaacgactgatttcaatttagtcttgatgtctgaaagcttattgattattttgagcttattagtaccaacgattgtttttcgctggctattgccgaaaattaagactgatacggatggtgcggccaaaatggcggtgattagagaacagatgattgaagctggagttcatgatttgtggcaaatgccgatttcacaagaatttaaagctgcggtgacgtttgacctacgttcacagaatggacacacgacagttcgacagtttatttcggaatggcgtcggatggtccaacatcctgaatatactgctgatgaaatgcgtgaactaatggttatttatcgacaagtatttcaaacggaacgcgattatttgcagcgacaatacgatgcgacacatgccattagcgaagacttggttaaccgcttgtatcatgaaattacgatggctgagatggttgttctggagtatggtgtgaagtaagcgggataatccaagattggtgtggcaagtcgaaatattgattggtgatcgtctcaaatgtaaaggcaccccaatacttattctctgtgaataagtattggggtgcctttttaagactgactagaaacctgcaattaaatagttggtaataaatattaagttggctgtcagtgtttaaatcaataagggggaatttttgttgattgccagaacttgatggggatattgcaagcgagtgtgattagttgtttggaaagttcggcaatgccaccacttgattcatccggggactgatatggtgcatgatgtcaaatatggtcattaggatggcagtcaaaacaatgactcgccggcgagtgccataataaaaattaatgctgggttgtttaaacgtgaaaaccaacgtctgattggctgcattgcaagggctagtttcacccgattgattgaaacccagaaatcaacggatggtctaacttgattaaaggcttaaaattgcattaaaaacactttgtggcagcttaatcgtatttttggacgcgcggcgtttattagcgctttgccgtcgtagtagggccgcttttttggaagtactgtgttgttcgccgttcaccgctgcatttttacgcaatggtgggacatcgacgcgggcgataaccttaccttcaacatgtgcttggacgggtgtgggatatagttgccgtggaaccgtcgtcttcagattggcgaccaattgctgcgtcatgttgggggcgtcttcacgatggacgatgaaggtcaacgcatctacgggcgcatagttgatatcaacttcaactttgactagatcactgacttcattagccataaaggcggtgcttaaactcgcaaagccatgtgagactgattttagttctgagaaaaagtggtaggcgatttctgacaagggtatcttgagacttgcaacaatcaagtccccgctgtttgccaagtcgatcaaggtccctttatgctgttccgcaagctttaatacggcatttagattgtcagcaggcatcgtgatctcggctttcataaagggttcagtcacttctttaatgagactgaatgccggaaactgaacgggattattgacgatcacttgctgaccattggtgagtgtaacgtggtaagtcacattgggagccgttgttagcacgtcgaccccgtactcatcgtggagtcgttcacgaatgatttggaggtgaaaggttcctagaaatccgcaacggaagccaacgccaagcgcctcggatcgttcttcaacataggtaaatgacgggtcgttcaagttcaatttttgaacggcttccttaagtgccggatagtcattattcttaggatataagcccgcgaagaccattgatttggctggttggtagccggctagcggccgctgcgtgggggtggcgacggacgtcagcgtatcaccaacacggacttttcgtggatctttaataccagtgaccacgtaaccgacgtcaccagcgcttagcgattcttgggggtgcatttgaggcgcgaagacaccaatggccttgccgttaaaatcctgttgtccttgcattaagcacagtgcttgttgtgatttgagctgaccatcaatcagtcggacataggcaatgacaccttgatatgggtcatacaacgaatcaaagactaaagctttcagcggctggtgtaagtcgccttggggagctggcaaccgctgcttgatggcttccaagacggccggcacgccttgcccggttttagcggagatttgcaagacttgctcgggtgtgaaagctgagtcgaggtcgttcaattgggccaacgcagcgtcaatatccgcagagggcagatcaactttattgagaactggtatcaaggttaattgacgttgtttggcaattcggtaattggcaatggtctgcgcttgaacgccctgagtggcgtctactaataggatggcaccctcggtagcagccaagcttttagccacttcgtaattgaaatcaacgtgaccaggggtgtcaattaagttatattcatattcttgaccatcatcggcctgatagtaattccgaactgtacgtgctttgacagtcacgccatgagcctgttcaacggtcatatcgtctaataattgggcgtgctgttcacgcgcactgacggtctgggtcagcgacatgatttgatccgccaacgttgatttaccgtgatcaatgtgggcgatgatggcgaagttacggatatgggattgtttcatttgtgcgaaaactccttcaaatattgggtcaagtagtaacgaatttgttgttgggcctccggtatgagtcgaatttcgaagtcgggataatcaacggataatttatgatgattaaagctggtcaaagccgccatatttatgagcccactgataatgccactttgaataatgaacaggtggctaaattgggactggtctaataagtggtctgtttggataacgagttgttgtcctaagtgttgactggcgcgatacagggcctcacgttgtgtgatggtttcctgcatgttagctttgccttctaggattggtccacgaatggcattcaatcgaatcagaacgctatgttcttcaattaattggcgagtttgggtggtcatccacgcgataaagtcgtcagctgatagtggtggttgctgggctaagtcggtcgtgagttgggtaaagtattgttgatagtcttccaataaaatcgtcatgaacaagtcttctttggtcgtgaaatagcgaaaagtcgcccccttagagctaccgacggcttccgcaatttgctgcatggtgatttcgggatagctcctatgggcaaataaattaatggcagccgtcatgatggcttgacgcttggctgctttttgactgggcgtatagatattagccatgtcggatcctcctaatttaaaaatgaccggtggttatctttgaaccagaatacgccaaaaataaccacgggtcaagattgaagtggtgagtgctgggctaagtcggtcttgagttgtgtaaagtaccgctgatagtcttccaataagagcgtcatgaacgagtcttctttggtcgtaaactaacaaaaggtcgttccttttaatatttaattattaaatatatggtattaattatagtttctattggaataagttcggagttaaagggagagcagagctgcattatttagtgggatttatcattacaactggcaatgattagataactaggcaggttgggtgattaaaagcgctatgtgtagtttgcggatattttggaaaatgataatcaggccgaatattaatggtgtccatccggtttattcggtctaactgtcacgtaagccttctggattaacaggggtggataaatgcaataaatacgttaaaatttttaaccattataaaataataatgttataattatacggtaaacaggggaaacaatactgtctgttatctattgttgataataagggtatcagcgcgatattaaatttatttttataatcaaactgtggatgaaaggttaacggctgagccgttagtctctaataaagggcgataatgattaagaaacggtgcaaaaagacgccagtacggatcagaagtccaaaatagcctgcgttatattgtaactaccgtgcaggctaatcgttggcaaggccggttaccaccgactagtgagcaagtgtgccaatggttactagttgcattaggtgttctactactgggactgttattgattgctagttagggtaactataaatgtgagcgctatcaatgactgaagttaaaagattacgctgtcacatagaattgctgattaaaaggagatggtcgggtgcggcgaatatgtaaagtattaatggtaattatcagtattattttaggaagtagtgcgccattgaatatggcaataccaccgttattggcgctggccgcgccggacactagtagttcttcgacgataagtagcagcgcaattagcaaagttactgataccaatgtgatggccgtgagtgcggatgtgacgagtacaacagacacgtctgatacgagtagctctgacagtacgtcggcgactagtaccacgacgggtaatgataccactgagacggcagacacggcagtggaatctggaactgttgggacggtagcatggaccattgacgacgcaggggtgtgaacgcttagtggtggtagctttgctgatttaactggtaaacgttcgccttggtatgattatgcttcatcgattacgaatataaagattacggatgaaattacggtcacaacggcttcgaattatggatacttgtttgctagcctcgctaacgtagcaacagtcacaggtttaaataagctttcgatgagtggtgtaactagtacccagtctatgttttatcgtgatagcaagttaacttcagtcgattttggacagaccgatttttcaacagtgactactatggaatcaatgtttgaagggtgtagcgtgttaactaaagtaaatactacgaactggaatgtcagtcatgtaaagagttttaagagaacattttacatgtgtgggaaactcactatgcttgatgtgagtaactgggatgtaacacaagtaactaatttagacagtacattttctggctgttcttcactgcctgagttagatgtcagtcgctggaatactgctaatgtgacaacactagcgtctacattttatagttgttcttcagtaaagataataaacgcaagtggttgggatacggcacgagtaaccgatatgactgctacttttatgaactgtactttggcaactgaacttaatgttagtggttgggatacagcgaaggtaactagcatgtctcgaatgtttttttattgtgaaaatgtcatccaactagacgtttctggatggatcacttcccaagtaacttcactggggagtatgtttcaaaactgttctaaagtagtaacgctggatgttggtacttgggatactagtaaggttacggatatgtcatttttatttggaggctgcagttctttaacgactttaaatcttgaaaaatgggatactggttctgtaacaactctttattccaccttttataactgttctgggttgactagtttgctggttgatacttgggatactagtaaagttacaaattgtttttggacgtttggtggttgctcatcattaacaactctcaatcttcgtagctgggatcttcaatctgctaccgccagttacgggaatttttttaatggttcaaaaaaattacagcatttgacactaggtcctaattttacgtttcataatgataagacgatgtacttgccggagccaagcaaacaactaccatacaatgggacgtggcaaaggaacaatgatgatccaacctatacgtcggcggaactaatgactaattatgatggcgcaaccatggcggggacctataactgggttaagacaagtggaacggtgcttgtcaaatacgtagacggcgatggtgttgaaattgcggatgaagagacgtcatccgggacatcgggtgatgcttaccaaacaacggccaaaacgattgatggttatacgcttcatgcaacgccaactaatgcaactggaacgtatgacgcttcgacgattacagtaacctatgtgtacgatggtaacttattcttcaattcgtcaccaacaatgctcgattttggcagtcatacaatatcgggaacaactgaaacttatgcgcctactctggataagacacttgcggttcagaacaatgggcaaataagttcaacctggaatttgactgcagaactcgatagttcaggctttgtgggagcggacactggaaaaatgttgttggctacattatattaccagaccgatgatggaaaaatgaccttgtcacctggggtagccgtacaagtctactcacagacaacgactgatcataaaagtgttgatatttcggaacattggtccagcaacttaggattgctactagaagtcccaaatggggctgccatggctgacacataccaaggcacgatttcatggcgtttgaataataccgtggccaataattaattagtgattcatagttaaaaacacagcttagtttgaaaggaagcgtattgtaatgaagaaattcgttttgggattaatgatttctgcaggacttttgggagccacaacggttgtggctaatgctgatacgactggttcttcgaccggtgatgtaacatttactgggggaacattgtcaatgagtgttgacgctactcatttagctttcggtagcaacacgattacctccagcgatgccaccttagccacttcatcgacaccaactattacggtaagcgacttgcgtgggactagtgcaggctggaccttgacagttgctcaggggcaacaattcaatacagatgaagaaggtgctggttcagccttgacgaatgctgctttgacagttgcgggtactgagagtgattcggcagtgacaaatggcagtactacgttaacgccggggacaacttctgccgcgggtgcagctgggaccgtcgcttctgctaagaatgggactggtaacggggcatcaacggtgacatttagtgattctaagctggctgttcctgggaaaacgactaaattagctacggggtacacaaccacgttaacttggaatttaaacgacacaccaggtaactaatccgggtgaacaattagccgatgttggctacggccaatgtcgatacataatctgagaaaaaggcggggttaaagtgcagaaacgattgcgattatctttgggaatgttattggcggttgtcgctagtctattaatgatgggacaagtagcctctgctgatcagggcgttggttttgaaatcacgccagtccagtctagcagtcaggtcgataagcgtctctcttactttgatttgaagttaaaaccgcgacaaacacaaaccgttgcggtcaaaattcataatacggctagtgagcccattacgatcaatataggtatcgctaaggccacgacaaatattaatggggttgtggaatacaaacatacgaataatcgcagtgcaaatttgccgtatgatattagcaaattagtgacaactgatgaaccacaagtcaagctggctaaggggcaagtcaagacggtcaagtttcaaattaagatgccggccaaaagttatcaaggcattttagcaggtgggataactttcctgaaaaaggccacggcaactgatactaaaaaggccgtggcagtcaataatcaatacgcttatactgaagctgtaattttgcatggtagtaaagacctaacgaccaatcagctgacgatgaataagattacggtcaaacagctcaatgggcgcaatgctattaattttccgttagtcaaccatacggcggcttacttgaataaagtgcaaactaacatcaagatttatcatcggggtggcagtcaagttgtctaccatcaaaagttagcgaacggccagatggcacctaattcaatctataaattgccattgcagacaggagaaaaagcgctagcagctggtaaatacacggccgttgtgaaagttacttccaaaaagcaacactggcaatttaagcagaattttgtgattacaaaggaccaagcggataccttgaataagacggcggtcttgaagcaagggcctaactggtggttatatatcgggattggcttattactgttattattgattatcctggtaatttggtatattcggcgcaagcagaagaaaatcaggtcgcttgaagaacagttagctgaaaagaaccgtcaagatagtgaatcataatcaagacgcaagtgcaatttaatcgattagcacagattaacaattaacatgaatagtggatatcaagggcgttttgggaatgtaatattctgaagatgctctttttgaattgtttgatataaaacagaaattaacgaacattgaatgactaataaccacctggagaataccggcatactattaaagtaatgttgcaaggattagatgttttgacgatatttataattaatgtataaatgttgttggagaatatggctctatgtttatctaaaatagttatagtatatatcatgactataggtgctaaattgaagttgagttctcagtaaagtgttgttatatcaaaactttggtggccgttaattattaggtctactgttagtaagaggtgtatactgattgataatatgagatatatagggtattaatactgttataactaattgaaaatgtttcggggtagatagaatgcaaagacgacgcttataacgagcacaattaacagaaaaacgaacttataaaatgtataaaaaaggacgcctgtggttaattgcagggttgagtactttcactttgggtgctagtctgctaccgatgatggggcgggcagacacgactagtacgactgctgagcaacaggggacagagacaactggcaaccaagttacattggctagtaagtcggttggtagtagttcgatggctaatgatggcgaagaaaaaactaataacagtcaggtagagacgagtagtgaagctagtaatgttactgcatcgactgaagctaagtcaacggaatcaacgactcagactgtggttgattccaccgtgactagtacggctactgaaacaacacgtgcaaacggtgctactaatcaaaccagcaaaatgtccatagtcgatacgacgtctaacaacacagaacagaatcaagcagtaggtggtacaacagacagtacggcaagtaccgcaactattgaggatcaagctgaggccgccaacagagcaaccactgatggcaagataaatacggctacagtagctacgaaaacaactacaactgccagttatgcaaccgcggatattagtacgaataccattcgcggtgcgcagaagctagcacgagctactgtggccactgttgcgacagtaaattcagcgactaagacgtatgatggtaagatagatacaccaaatcgctatacgattacgctaactgacggaactaaggcgccttcagattgggctgtaacgagtactgcgaatgtttatacggttactgacttaacggacgttgatacgtcaaagtttggatcgagtgttggaacatacacattggcactctcaacggctggaattactaagctagctgaagctaatagtagcgcggatataacggctgctaacgtggcgacaggaacactaacaatcaagcaagctccggtaccgactgcgataattaccattggttcagccagtattgactatggggatgctaaaccaagtacgtatacaattacggtgccgagtcagtatgcagtccccagcacctggacgttagctagttcggctactgatggaacgactaatacttatacgattgcaagttctagtggcgatgttatggttcccacagcaacccaatctggaacgtatcagcttgtgttgtcagatcaaggcttgacagctttacaacaagctaatcctaatgctgctattactgctgatacgattattgctggtagtttagttattgcggcacacgacatcattacgatgggtgcgacgacaattgtcgttaataaaacgactagcacggttccggtgacagtcaatagtcgtactgttgtggttccaacaggttggacaattcgttacgatgatattcagactgatgcgattgtgtatgacgtccccgtttccgatacgacatattcggaagcggttaatactgctgtggttggtaaatacaccattacgttgactgatgatacgatgaaaacattagctaaccttaacagcggtacgacttttaatagtacgacggttggtgagggcgtagtgcttgtcaaggctagtgccgcagttgccatctcacctgcaaactatggcgcgcaggctagtgccgaaactccggtaacagggctgacaatttcacatgcccgaacaaagggaattgatttagcatatggtcaggcgctgtatttaatcttgccgcttattaatatgaatccatcaggaatgactgtggctaatcttactgattatgttattattccatctggttttaaggtcgctactaatagtgatggggctgttgacatcgcgactgatccaagtagtgtgttaacgtctgctattgaagcaatgatgacgaaaaatgatgtgacctatcaggggttaaaggtgacccaactgacagactacaggggtcgccaaacatttaaaattcattttgatcaaaccactgtttatgacggtggtgcatttgcaacgctaaaatatgcattattaccggtcattgctgttcaaaacactggggtgactagtggtttaattggtaatcaagtttcaagcccggattcggcggtggtttatgttactgatgattctaatgaaaataatggtagttattcgttgaatttgcaaaattatactaatattgacagtgtcgctgatgcattaggaattgcggatgctgtcacgattggtagtggtttcacaagttacctatatcattacacgctatcggccaaaacgattaccgatacttatagtttagtaggaaacgatggcacgtcattaggcgaagtaacttttacgggcgacagtggtaagacgtatgtaccgatgactaaattacccatgacaattacacaaaatggcgtgacgtattatttgaacactagtgcagtttcgttaactcagacatattctggtgatagtaattcaaattacacagttacttaccagcgctacgtcacaacgacgactgatactgcggccaagataacgattgcaccagcttcaaaagtctatgataacaacgtcacgactgatccaagtcgctatacggtatacttgccaactgaatatacggtcccaagcgattggactgctgatagcgcggcgacggctgtggatgggacgacggcgtaccaagtcagtaccgactaccttaataccactgcaatcgatcaaaacgtgggcacttacgccgtcacgctgaacagcgccgggatggcagccttagccgctgctaatccagacttcttgattgcaggcgatgtgaatgttggtgggactctgacgattactcaacgtccagtgacgattactttgccggatacgattctgtgggccaatggtcaggaacaaaatattacgccggtcattactggtgttgttgcggtgcaaagtttggattacacgttaacgtcagggttaactgatccggacacgacaatcattacggccacgctgacgaatgccgctgctaatagtaattataaattgacgaattcacctagtggtcagttgacggtgggcgccgtaacggttgtctatcagtatgggtaccgcgacaaagcggggacgctacacgtggtaacaacggctaatggaacggcgacgcacgggactgatgttaccgctaaggactatttgagctacaccacgagtgatacgactgctacgcatgccaaaactggttatacgttacaaccagaaagtactggctaccaagccgatggtactttagcggacattggtggtcaggtcgtgtacacctatttagcgaacacagaaaagattgcggtcgtttacgtcgatcaagataagaacaacgtgattttaaatcaggtccccctcagtgggagctttggtacacacacgaattatacgacggcgcaggacattgcggcgtatgaaaaattaggctacgtgctagcttcggatgaggtcccagcgcagcttgagtttgatcaggatactgaacagacctactacgtatacctgaaacatggcaccatcacggccaaggttgatcagccaggtaacgtggctgttagtgatttgatgaagaccagtcagcgaacgattcattacgtttatgctgacaacacacccacggacttagcggatgtgcttcaaacggtcacgtatacgcgcacggcaacggtggatgcagtggatagaacggtcctttcgtacggtaattggacgaccactgtgaatagctatccggccattgagtcgccgaccattactggttacacggcggatcaaacgaccatcgcggcggctgtacccgctagcatgggcgaggctacggaagcaacggtccgatactccgctaatcttgaaacaatccgggttcaatttgtcgatgggactacggataaccaggtcttaggttatattgatttgaatgggaaatacggtgatgctgccgactatacggtcactgctgacattgcgaagtatgcaaaattaggctatgaaccagtcagctcggatttgcctgatcagctgatttataatcagaatgcccaagtttatacggttacactagcgcatcgtcacgtgacggtcagcgttgattatccgggccaacctggtcaggccatcgatgctgattatccagccggtcctaaatatccggcaggcactggtcgtgattcgttgcaacaaacagtgactcggacgattacgtatcaatatgcgtcaggtgaatcagcggctgaaacggttaaccagtcggtcacgttcaatcgcacggcaactttcgacatggcaacgggtaagcagctgacttacggtgactggaccgtagcacctggtcagtcagcactattggccgcggtcacgtcaccaacgattacaggttatcaagccagtgttacagaagtcgaagcagcgtctgtcactagtcacgataagccgcacttgattgcaatcacgtacacggccaaatcacagaccgcaaccgttgcgtttgtggatgtaacgagtggtaaaacactacctacgacggtagtaactggggcttatggcactacgaatggttattcgcccgtttcacaaattgctgcgtatgaacaactgggctatcgattagtttcgaataatgttccgacgactggcatcatttttgatcaagatgacgtcattaagtcatacacggtcaagctagcgcatcaaatgacgacggtcacgccaactaagcctggtcaaccaggtcaaccagttgattccgctcatccagaagggcccaagtacccagctggtactgggcttaaagatttaacaactagtgttcagcgagtcattacctatgtttacaatgatggtcaaactgcggcgccaaccgtcacgcaaacggtcagttttgagcgcaaggcgacctttgaccaagtgacaaaggtggtgacgtatatggattggcgtacacctgaatcagcgttgacgggggcatacgcagtcgttgaatcgccaataattgctggctacaccccgaacgcaacccgtgttgctagtgtaacggtcagtgccaaagatactgagtcgcgacaaacggttacttaccaagcaaatctggaaacggcgacggtgacttatgtcgatgccacgacgggccaccgactgggtacaagcgtgacgttaaccggacgattcggtacgcaagcggattatcaaccagcgacgatgattgcgcagtatacccaggcaggctatgtcttgatggggagtgattatccggcaacgggtgttacttttaatcaggcgggcgtcgttcagaagtatacggtgtacttggctcataacaaaatcgtgattacggcaccagatcagctcaccaaaacaatcacgcaaacggttcactatcaggatcaggctaggcacacgcttcaagctgatacgatccggacgctgacgttcacgcgttctgggattgaagatgcggtgactggtgtggcaacgtatcgtgactggacaccgaccgggttgaactttacagccatgtctgcgccaacaattgcgaaataccatgcgttgacggcgaccactcaggccgtagccatcacggctgctagtgctgatgatgtccaaacgctaacatatgcgctggacgtcccaacaccgacgaaaccggtcaaaccgactaagccagccaaaccgactaagccgacaacatcggacgatttagtcaagccaacgacgaaaccaatcacggctgctaaaccaacgcaactcactaagccagcaacggttgtgaaggattttcaagccacaactggcaaccagacgccagctaaatcgacaaggacgttggtatcgagtcgcattaaggctgtcaaaacagctcctgcatcagcaatcatcaagctgggaagtaaagtaacggagccggctcacaaggctcaagcagatacaacgagtcgattgccacagaccggtgaaacgcggcggtctgaagcagctgaaacactagggctaacgctagcagcattattgctaagctttggtggtttgaagcgtaagcggcatgaaaagtaatgaatttatttaactgtgcataataaaaaacgcttaacatcctagcattggcaaaaagtcaatgggaatagggtttgttaagtgttttttgttgtgtttaggtatcaatggattgatgttcaaagtagtcgattttagttgccaataactgatcgattgcttccagatgccggatgcgatcccgaatgacttgttggtactgcttgaaagcgactacttttgcttgaccatctagtgctagatgggctggtgtcaatagacttaaatcgagatctaagtcccgaaatattttaatgagttggagtgtttccaagtttttgtgggaatattgacggtaattgtattggtttcgctgaacatcaggcagaatgccaaggtgctcgtaatatcgtaacgcatctttagtcattccagtaatcgtggtgacttccttcgtagtgaagtagtgctgttgttcaggaattttaaacgttaacacgagcgtctccttaatattgagaactgagtcgccataagtcgttggccttagaacgagtgtactgcttagataacggaacttgacgtaggcggtcatcgtagaagtgtccacttgtgtgagtgagttcgggagcagtagctaaccatgcaccaatcggggaatttttacgagagaaactttcacccagtatccgaccagccaaacgactcacccaactaccgccagcaccaaagttagaatctgggacatagccggggtggaaaatgttgattgtcacgttggttgctgttaagcgttcactgagagctaacgtgagtagtacgcgcgcagcagtggcctgggctgtgacggtcatggcattgtacttggatgtggcctgggcgtcaaagtctggaagactcactttagcatggttaatcacgaatggcagggcaccaaccaatagaatgcgcgcctgatcactgtgctttagcaacggtaataagggttgaatgatccaaaaatgggtgaggtaatttaaaactaggttcaaatcataaccatctgccgataaatgtcgctcaggtagcatcacaccaatactattgagtaggatatcgatgtgatcagtcatagatgcaagctgatgagcaaattgttgaacaccagttttggtactcagatcggccaaagccaattggacagcctgattgccagttgcttgactaatatcggcttgagcctgtcgtcctttgtcagcccgactgccaacgataatcacatgatagttttggttggcaaggtcaattgcggtttgtttaccaacgccagaagtcccaccaataataacagctaattttgattgcatgtcagtcactccttcaattcgatgattatgcgcaagtataaactatggggtcgacccgatagcaagcattaaattaattatgacgtgcagtagttattggcgatttagaacataatcagcagagtccttctatgctttaaacctatgaatatgtatttaacataagcatttcacatatatagtgaacgctcgtatactgaatttaacttaataagggagggacgcaccatcaaagcaaagtatttagatcaagattatctgcaaacaattcagccaattgtcgatgctaatcagcgccgcattcaagcgttgaatgtaacccgggaaccaagtgaaattcgtgaacgtcttgcggagataacgggtcaaactatcgatatttcagtcgagattcgcgtgccactgtggacagactatgggcggaatttaaaaatcggcaaacgtgtttttattaatgataatgttcaggtcactgatttaggcgggattgaattagcggatgacgtgctgattggtccgggtgcgatgttactatccgttaatcacccgttagatcctgctaagcggcatgcggttgaagttcagccaattcacattgaacgaaatgcctggattggtgctggtgccaaggtattagctggcgtcacagttggtgaaaatgctgttgtgggtgccggcgcagttgtgacaaaatcagtgccagcaaatacggtggtggccggcgtccctgctaaagtaattaaaacaattgagcaagtagattaacggaggttttataaagatgagtattaaaggtaaagtggttgttattacgggtgcgtccagcggtattggtgccgccacggccaagttgttagcggctaaaggcgctaaagttgtattgggggcgcgtcgagaagagcggttacaggccttgagtcaagcgattggtgacaacgcggtctatcaagtaactgatgtaacagatcggcaacaagttcgcgctttgattgacttggccgtttccaagtttgggcgtgtcgatgtgctatataataatgccggtacgatgccccagggtaatctgagtgaccgtgaatacgataagtggcagatgatgttgaacgtgaatattatgggggttttgaatggaattggtgaagtattgccaatcatgcaaaagcaacatgatggtttgattatcgcaacggattcagttgccggacacgttgtttatcccgcatcagcggtgtataacgggactaagtatgcggtccgggccattatggaaagcttgcgacaggaagaaaaggaacacggaattcgttcaaccatcgtgtcgccaggtgcagttcggacggagttggtcaatacaatcggcaatacgcaaattcaggccggtatcagtgagctgatgaatgcggacgatcgtcaaggattggctttaaatccggaagatattgctaacgcggtattatttgcgatcgatcagcctaaacacgtcgccattagtgaagtgttagtacggccagcacaacaggaagtttaatcattaaatcaagtgatttaaatagtcgcggcttatctgtaagataggtcgcgactattttttcgatatattaaattaagttggtaatcctgtctgaagataccttagtcttcaatggaattattgttttctggtttgaatactccggatttagcatatacaagtagtgcaaataaaatcatgagagcagcaaatattgaaattcctaagtaactatgaaattgcttgaataggactccacctatgattcctgcaagtgtttcgccaaaatacatagctgcatttgatagagaggagacagtgctacgggcattaatcgtcgtactttgtaatgtcgtcatgaaaattggaaaaatgaatccattaaatagaaaagcgagtgttagtacgatttcagcaagccaaaaagtagtaataaacggcaaaatcaaatagagcgtaatcaatgcgatgagttcaaacaagaaagttttttctaatcccattcgattaactaaattaccactaaaaagtgaccctattaagttacctgcaccaatggcaatcattgctgttcctactcctgttagcgttaatccaaagctatttgtaaaccatgtggaaatgaaagtaatggcggtaaatgagcccgtttgaaaaattaagtatgcaaataaatagttgagtgctttggaattatgcaaaacgctagtataagttttaaagaaagaagttttgaatttatgaccaaattctaattctgggagggcaattgcatttgaaataaggagtattaatgctgccccggagattacaaagaatggtgtatgccatgagtttacagctaggtagcttccaatgggaatacccactaattgagacacagaaagaccagcggtggcatatcccataactttgacaatatgttttttgtcaacaataacaggaattgatgcccatacttgtggtgtgacgaaggatgcactaacaccggctaaaaatctaaaaaataacatcgctgggaaagtgtaggaaaagccacacaaaaatgttgacatagaaaaggctagaagcccccaaatcataacctttttacgatttctcccatcagaaattggaccggaaatcaaagcaaaacaggcatatccaatggcataggcacttaccatccagccagaaatactggttgaaacaccgtacattcttgccagggttgggagtagtggtgaaatcagaaaagtatcagttccaattaggaacattgttaagaaaaacattaatgagtatctgcgcataatttatctcctacgatagttttaaaaccatcaaacaatcaaccgaaaaaaagataccttatttacaaggtatctaagaaaccaggtagaatttcgttaaaagcatcaatatttagagagacatatttattttgcccttttttacgagttgttgttaaacctgcttctctcaaagttttaaaatgatatgaagcggtcgatttgtttatatccaagatctcacctatctctccacaactcatctctgtttgcttttcataaagcattgctatgatgtttaaacgaacctcatctgatagagctttgaaaatttgaattctgatttcgttgtcagataattgtttgataatcataaaactatattactgttttaatcattttaagtcaataatattatatctcgattcttttacagacatattcatattttatcagtaaatacaacgacatttttagacaagtgtcgctatcgtgaatagtatggatactttgttgctgtctttgcgctgtgatcatcgttaagatagaaggcaacgaaagcctcgaattaggtgtgtcacaagtattgaatattgaggattaactaaaatagtgcatatgagcggagatggttattgatgaaagtgtttataacaggtggtacgggatttgtaggtagtgcggttgtacaagaattagtcgctaatggttttgaggtcgtcggactagctcgttctgagacgagcgctcaaaaactcattagttggggggctcagcctgtacgcggaagtttgactagtttgtcaacgttggcgacggctgctgctcaggcagatgccattattcatttgggctttaacaatgattttcggcatttttttcaggctggtgcaatggatcggcgggccattgaaactatggggcgtgccattagtgggactaataagccgttggtcgttacgtatgggacgacgggcattagaaagcatgtcgagacggagcatgaagtcgcggatactgggctactcaaatggctcacaccgagaaaatctgagatcgtcgcacgtcagttaatggctcaaaacatcaatgcgtttgtcgtacgcttatcaccggctgttcatggtgcgggtgatatgggctttactagaacagtgattgagcgtgctaaaaaaagccaccgtgccgagtactttggcttaggaacacatgcttggagtgctgttcatcggttagatgcggcgcacttgttttatttagtcacgatgtatggccttgagcatccaacaactaacgagcgtgttttcaacgcagttgccgaggaatcgatcacaaccgcggccattgcgcgtacgattagtcgtaagttaaatgttccattaaaggctaagtataatccactgagttttggcgacacagcgatgctttacctaatcaattgtccgacctccagtcagcttacacgacaaatattaggttgggttccagtacaaccagatttattaactgatattagtagttcacggtattaagtgggttactaaaaatattgtccaaggtagccgtatccgtgaatatattataaggcgcattgcccacggttatccataaggtgagtcccttgatacgtccaacagctagaaaccggactagtcgttgatcatcgtcaacagtatctttacacagatggattagataattcaggaatgcatcgcgaaaggcgtcatcgttaaattgatgacgcaatgtttcttggaaacgcgcattgccgaatgagttgagcgtttcaaaaggatgtgtgaagatctggtcaatagttagcttcgattgctgccgcttttgttcaaatagggcttccaataaatcgtactgatcttgaaagtgcttgtaaaaagttgaccgatggactaacgctgcatccgaaatatcttgaacggtgatttttcgaaagggcttgtcactcagcaggttttcatatgccagtagaatcgtggcctgcatccgttgatttctttgattagccattacgaatacctcctcgaaatttaatagaatacgattagtataacctgtccggtgtgccgatacaaagatgtggtgtaagcatttgaaattcagagcgcttataagcatgtgccctgcggcggtatagtcaagggactagaattggtaagccaaccaaatattttaatgattaatcgaaaaaaacgagtgcaatagttggtatgttcatgcatacgacacgattgcactcgttttaaggtttatttatccccgcactaacaggtaaataaaatatggcgctccaatcaatgcgacgagcacgccggctggcagttcagtggtcgtggtgattagttttcctaaggtatcggcagctagtaataacgtactccctaacagaccagctaacggcagctgatagcgttgtcgggatcccacgattcgtcgtgccaggttgggggtaatcaggccaatgaaactgataccgccactaatggcgacactgacgccggctaacatggcggccacgctaatcaatcccaattgttggcgtttcaagttgattcccaatgtttgggcagtggtcgtaccgagtgtaaaggcgtcgagaacgggtaattgaatgaatagaataccactaccgactgccagccatggaagcgcccagccgatataagaccaatcagtgccccacaaactaccggccaaccaattcatgacaaattgatagttatcaggtgataattttagtgtcatcaacaccattaaggctgaaaaacagccggacaaggcgacgccgaccagtaacaggcgcttagacgagatccctcgttgacgctgattcgctaataaaaaaatcagggccgtacttaaccacgccccagctaacgcaacgataggtaaactcagcgttaacgaagcgttggtgcctgcaccaataatgagtaacataacggctagtccagcgccgttattaattccgagtagactagggtcggccattggattgttggtgaccgtttgtaagacgttaccggataatgccagggcccagccaaccatgatggcgagcacgatccgtggtaagcgaaagttgactaagactagcatgtcggtcgcattaccgcgaccagttaaaattcccatcagagcgggccagctgatggtcattgtacccgtactaaggttgagaatcgctagtccgagcatgctagcagttaagagcagtgaccaaataattaagcgacgattagggctcatgctttcatcggctcctttcgtgcaaggtagatgaagcacggtaccccgattaaggagataatgatgccaaagggcgtttcatgtggcggattaactagccgtgcaatcaaatccgcaccgaccgtcagtgttgcaccaaggatcaacgttaatggcatgctattgcggtaattagcgcccactaaccaacgcgccatgtggggaatcatcaggccaacaaaagtaatcgtaccaactaatgccaccgagatcccggataaaatgacggcacagatgagagctaggcctcgcagtaatgggagacttttccctaaactctgtgcattgtcgtcagtaagataggctaagtttagttgcggtgcgagtagtagggtcagtagcaatcccaagactagtcctggaccgagaaactttaattgtgtccagctgacggcacccaggccaccgaaataccagaacgcgaggtcctgtttgagctgcaacacaagggccagcccttcgctcagagctgttaataggctactgattgcaatcccagcgagtaccagaatcgtgggatcgagttgaacatggcgggcggtgctgatactgaaaattagtccggcactggctgccgcaccaataatggcccaaccagtcgtttgtaaagttgataactttggaaaaaaggctaaacacagcgttagcattaagcccgctcccgcgttaatccccagtaagcctgaatccgctaacgggttacgcgtcactgcttgcattagggcgccgctaccagcaagagctgccccaatcaacgccgctccaaggacgcggggcacacgaatgtgccggataatttgttgatcaagattgccagtgtgtgtggtcgtcagggcgtgccagacggtggccgtacgcatctggtcagcgccaaatcgcaaactgagccccatgacgagaatgagtacgccggtactaagtgccagccacccccaatatctggacgttgacttcatgcgggggccacttcctgacagccgttataggtcaaaatcagtggggtaccgtggtagtcaacgagggtggcatcaatattgaaaattgtttttaagttagcggccgtcatgacggtggacacgggaccgtgggccaaaacgtgaccgtccttgagcgcgattaattggtcagagatgcgagccgcgtggttcaagtcgtgtaatgccataatgatagttcggtgggcctgttcgttgagctttttgacgagttgcatcacttctaattggtgagtcaaatctaagtaggtggtgggttcatccagaataatcgtgtcagtatcttgagcaacggccatggcgatccatgcccgttgacgttgtccgccagaaagggtgcttaggggccgttggcgtaaatcttggaggctggcctgagtgagcgcccattcgattttttgatggtcagttgtggtgagcccacttaacggccgccgataaggtaagcggccaaaactcaccagttcttctacggtgagatcgttagccgtttggttcgtctgtggtaagactgcaatctttttcgcaaaagttttgcttttgatttgttgaatgttttgatgatccagtagaataacgccggttgttggtggcaataggtgggcgatggcacgaatgagggtcgatttaccgctaccattcgggccaatcagcgtagtgatctgaccatgcggaatcgtaattgatagctgatcgacgataaccttgtcgccataaccaatactaatattttgggtttcaatggtattcacaaataggattcctttcttaaagttaagcgttcaaggaggttcgcttaataagttaactaattttgtttagttgtgcacaatcttattttgccagcttgtttgttggaaaacgtgattaaaacaactgctaactaataattagtgttcaattgatagtcttatcttaaatgtttttattgacaattgatagtgttttcactaataattttggtagcgcttgaaaggtggagacagttgtgacaaaacggtggcaaattgtaaaattgggattagtattggggttaatgggaagcctactattaggggcgtgcggtgcgaagcagccgacaagtacgacagttacacgaaccgattatttgaagcataaggtcaaggtgccgaagcatccgaaacgggttgtggcgagttatttggaagatgatttagtggctttaggcattaaaccggtcgtgcagtggtcggtcaaaaatggtagtggtacgcaggcttatttgaaaaagcagttgaaaggggtgccgctaattgactattcgttaccatatgaagcggtgaccaaggccaaaccggacttgattctgatggggacgagtagtgcggtcgccaatggcaagtatgcgcaatataataaaatcgccccgacctacgtggtcaaaaatgggactacggtaacgtggcgccaaactttccttgatgtggctaaggtggttaatcgccaggctaaggccaaaaaagtccttgctaagtatgacgagcaggtccaaacgacgcgacaagcgttgaaaaagtctggtcagcataaagtggcggtgttgtgggtcaccaataataccgcctacatggtcaatgacaattcagccagtggggccttactgtatcaagatttacaattgggtgaaccaagtttagttaaacaagtgtctaagtcggccacggcggattggtcggcggtctcgttagaaaagctagctaagttagatgcggatgatattttcttagtgaatagtcaaaagagtgcgtcgctatttaaggacccgctgtggaaaaatatcaaggccgtgaaaaacaaccatctgtaccagtatggtgacagtagcagttggcagtattcgggaccaattgcttattcacaaatgattgatatggtgaagacggacttgttgaaataatagttagtcaatcattataacgaaaaataataggattgagataaaaatttaaaacgcgtaaattactcacagtaaaataagtaatttacgcgttttattgtctatagacagcggtaatcatcagcccaacgcgtgttgataggcggggactaataaatcatcgacaagtagatgaagggtggcatcagtaatcggttcattagcaaaagcacggtagcgaagccagtcgaatggcatcagttgtaagtcgcacgataaagttcccgtacgcagttccccacgttgctgtgcacgctgacacacgcgttcaatcgcatgggcatcaatctttttcacagcattgagcaagtccttaacttctggatttgcttgttgatctaggtggtgaaaccaagtgataaccaaagcttgattgaatgtattaatactgacagtgaagcgcttgagtacttggaataaatcttcagaaagtgtctgaccggtcaagttcacttcgtctagttgaccatggttttccgtaatgatttggtcctggatagccgcaattgcaagctctagtggtgaacgccagcgtcggtaaatgacaggcttactggtgccggcctgttccgcgacgttagcgaacgtcaattgttcaagaccatcttgatttaagatgtcacgggcggcttgatagatggcgttttcgagttcagcgccacgacgacgtgttttagtcatgtaatccctctttttaaataagatactttaagtttcttattgactttttctttatatagcgtattataccagttatgcaaataagacacttttagtttcttaattaggaggataatatgcaagcaaaagcaaaaatttcaaaagcaactatgacgattgcctgggtcgtagtgtttggtgcgatggcaccattattagattcaaccatgataaacattgccattaacaacttagtgactagttttcatagtagcgtgacgacggtccagtgggcagttacaggttatttactggcaacgggggtcgcggtgccattttccagttggttactcaatcgatttgatggtaaagcagtctttgtggctggtgagattttgtttggtcttggctcgatatttgcagccgtagcactgaatattcaactattgattatcgctcggttagttcaaggttttgcgggtggcttgattatgccactcttgacgaccttgcttgtgcaaactgcgggtgcagcagtgatgggccagatgatggcaacagttgggctacccatgattttaggaccattaatcggaccggtcattggcggaatcattatcaaatttgcatcgtggcattggattttttggatcaatgtcccagtagtcttgatttcaatcgctttgattttgtggaagatgccgaattatccggcacaaaatcgaacagcgaaaatggactttattggtatcttgctactaattgtgtcctcaagtgctatcatttatagtttggttaatgccgcgcatactgaccgttttaatagcgcgacaagtattgagatgttaattctaggggcgatagcgttgattagttatgtcgtatgggccgcttggcaaaaagaacgggcggtagtgccactgcacttatttaagtttgcatcatttgatggtgctggcttaggattttttatcgctgggacggtattgaacggcgcaatgttgttactaccactctattttcaaaacgttcggggaatgagcgtgattaacgccgctctagcgctattacctcagggagcgggaatgctagtttcgcggacgttaacgggaaggctaacagatcaaataggcgctaagtacgtggttctgggaagtgtcgtcatcacgtttgtcggtaccttaccgttttattggtttggtcaacagacgtcttactggattttggcacttattttatttgtgcggggaattggtgctggtggtattttaatgccgttaatggccgatgcttatacaggaatgcaacctggacaagtgccagctgcaacaattgggaccagaattatccaaaatattggaagtgcgtttggatccgctttgattacgacgattgtaacggcgtattccacacaccaagtgaatgtgtttgaacgacacctaaaagcaggaacgtatcacgtcgacgcagctcacttacaagtctttacaacaagccatttgcaagcaattcgcttagcagcgtttcaacaaggctttctagtgattgcaattgccgcaatagttattattttgccaaccttattgctgactaacaaattgaaggcggcgaagtaacaagctaggagaaaaaataattaaatctgcttgacttatagtcggctctaacaactattattagtctcgttgacagatgtttttaactttaattcatcgaaaaggggataacaattatgaagacaattcaaattggcgctagtcagctcaaagcgtctgcggttgcgctgggtattatgcggatggttcgtttagataccgatgcggcagcgaacgtcttagagaccgttcatgaccgggtcgttaactttattgattcagcggatatttatggtaacggtgattcggaacggattttcgggcaggcattaaaacaatcgagtttaaagcgggaagacttttttattcaatccaaaggtggcattgtgcttgatcctgagaagagttctggtgaactagtcttcgggcaacgctatgacttttctaagcagcatttgattgcaacggtcgataagatcttgcaacggatgcagctggactacctagattcgtttctattacaccggcccgatccgctgatggatcccgccgaagtcgccgcggcgtttgatgaattgcaagctactggtaaggtgcgtcacttcggtgtttccaactttaacccgatgcaagtcgagatgttacaagcggcagtcagccagaaattgatgatcaaccaattacaatttggtgtcatgcacaccggtccaattcagtttgggttgcacacgaatatgcaggatacggctagccttaatcatgatggcgaaattatcgaatattcgcggctacaccacatgacgattcaagcttggtcaccctatcaatacggcatgtttgctgggacctttattgataatccgaagtttccagaattgaatgcgaaattacaggaattggctgatcaatatcatgtgactaaaaatgcgattgcgacggcttggattttacgtcacccggccaatatgcaggtcattttaggttcaatgaatccgcaacaccttgatgagagcattgcggggaccgatgtgacgttgacacgccaggaatggtatgacgtttactttgcagcgggcaatgatttaccttaatttgaatagtccttgtgatgattaattaatcataataggtttaggttctttcgaaacggttactagtctcgaaagaacttttttgtgtggtgcaattgtggttgttataacttggtgtattgatcaattgctgaataaagtcagaattgactttattggtagttaagcggtattaatcataaaattgagtaatgatagattataaggaggaacgattatttgaacaaggcaagattagaggcgtttacagatgcgattatcgcgattgttttaacgttattagtattagacttaccgcggcctcaaactccttcagtgcgggcactctttgcggaatggcaaagtatttatgtttatatcattacatttacactattgatttcaatttggcttaatcatcacgatttattcgtgcaggtcaaaaaaatcgatcgggttgttttttgggcgaatagtttctggttgctatgtcagtcttttattccattcatggcctcatggattactaaatttccgcattcaaaatggcccgcagtattttatattcttacgggttttgtttggatgttggcttatcagttactagtagccgccgttagaagattaaatccacacattcatcgtatgagtagtccggcattaagtgttgtttttggtggctttttagtggttctaacagtcgcgttaattaatcccgatgtgggcttgttcctaatccccgttcacgcatttgctagtgttattttggcgactaaacgtaagtggcatttacgcaagtatttttaatataaagatgaaattaaaaagtaggctcatatctggtttaggctagtatcgcaatgataacgaacgacaacgcccgcaaggttgaatactgagtccaatcttgcgggcgttgccggttagtatttagttggtgttagtaggagtatgcttatggtttggtgacgattcctaggtcaatcatagattgggcggttgcaataatcgattccgcagtgggacggggatgccaatccaacaatgtttgggctttatgattgctcgtttccgcgtaggtgccaactagtgaggcgaccattcgcaattctggtcgggccttagcggctagcttaactgctgcattggggatggttttggttggtagctgactggcaaaagctggaaaggcctgtcttaagacatttgcaacgtcaagcatggatagcgtctcacccgttgtggctagaaaacgttcgccgttagcttgcggtgcggtcatggcaagcaagtgcagactagccacgtcacgaacatcaacataaccggaatcaacgtttggaacggctttaacttggccttctaagaattgttggatttgaatattggaatgtgaatatttggcggacaacaccggacccatgactgcaacgggattgaccgttgttaattctaacccgcggccctcatggttaataaagtcccaagctgctaattcagcacgtgtcttggattcttgataaggatggatcgctttccagttgagatcagaccagtcagcttcagtgtagggggtcgtacgatttttgtgaccagcaaagatggccccgtacgcagacgttaacacgactcgtttaacgcccgcatcacgactagcagttagaacccgccgaacaccgtcaacggctggtcggatcatttcagctttgtttttgaagttgagctttggggttggggaagcgacgtcgatcgcataagtggctccggccatcgcttccgaccagtgttcatcatgcgccaggtcggccacaacaatttcgagagctgataagtcggtgataccaccattggtcagcatttctttaataacgggtgctttggctaatgagcggaccgttgtgcggacggcgtagccttgttgtaataattgacgaatgatatgaatggcgataaaaccgctaccaccagtgacgacgactaattgtttttgcatgggactacctccaaatgaatttatgaattgctgttacacttgtaacgtctgtgccagtatcttacaatggggtcacgacgaatacaaggtaatcacgagcatctgtgacagaatggaggaattgttatggcagcgaccaatcacgcgcaagcaatcaaaaaggattcacaaacttatttaactacggccttattacaattattaaggactcatgatttagatacgattacggtgacccaagttgtcaagcgagctggggtcagccggatggccttttaccgtaactttacgacactcgaagatcttttgacagcgtacttcgccccggcgattgcagcgcggtttcaggacgtcttgcagcatgtaccggccaatcggaagttattagcgatgggtcaattttttagtgattttgcgccgacgttacgactggctgagcaacgtggttttgaaaacattattcaacaactttttaacgctaatatgactaattattaccaagcaacgatgactaatggaatgctcacggcggtgcagcttaagtattggacaagattcatgagtgccggggtatacgcaatttggcgcgaatggctacttggcggacagttggagtccttaacaacgattcatgaaatactagcaactttgcagacagcaacgatgcaggcgctgactcaggctcaaaaatgagcagtggaagaatgatcctaaattagcggtgtgaggaggtcgaaacgccgattttagcgtgttgattgggtacttatgagcaattgtaaaagccacctagccatgcaccggcagagctcggtgcggttaggtggcttttttaatcaaatgagctgagattaagcatcttgggccgtggcagcaatgtcaacttcacggatattgacattttgcggcatgtcatacatgaacttgaccgtggcagctacgtgcttggggtccaaagtcaggccacccatggaagctttccatgcttcgtaatcggacagtgccgacttgctagtaacgtgggttaacagctcagtttcggctgcaccgggggctaccagcatgacgcgcacgttcttcggcgcattttcttcacggagtgtctcggatagcccgtggacgccaaacttggatgcaacgtaagcggcgtgattgacgaacgttttcttgccagctaacgatgacatattgagaatcgttccatgttcccggtcacgcatgtcatttaggacaatttgagtgccgtttaaaacacccatcacgttcgtattaagcatggtttgccactcttgtgggtcctgattttgaacatttcctagtaacattaatcccgcattattaactagtaagtcggttttgccatacttggcttcggccttgcgaacggcagtttcgaattggtgatagttggtcacatcgactgtgtcgatcatggcattttcaaagttcgcagataaggcggctaactttgcttggcgacgccctaatagtaacagtgggtagttgtcagcggcgaataacttggcaatctcggcaccaaagccagaactggctccagtaatgacgactaatggtttcattttgtaattcctccgtaattttggataatggttttcgtttgaattttcaacgatttacagtatacttggctagattaaacgcgacaagtacgcacttttaggtaaccaccaattgagagcagggagttaataatgttaaaagaacgggtaactgcgcaaccacgctaccgaaatgaatttgatgccacgatgcagttgattcgtggtaagtggaaaatcatgattttgtttgaactggccgaggttaaagtcagccgttttgctgacttgcaacaccatattcaagcggtatcgcataaaacactggcgagtcaattgaaggaattggaacaagatgagttgatcgaacggcatgattttaagaccgctcagccgcatgtcgaataccggttgaccgctaaggggcagagcttgattcccatcctagatgcgatttgtacctggggtgatcaacatgttgatccagctttgattgaacgttcactgtgtgacgaataggctagtctaaacgggagcgtgggctttgtacggcgccatgggaaaagtacgttgtcagtcaaaagcaactagcggcgctgttttgatgaccattactaaataatcgcttcaagaatttctaatgacattcttgaagcgattatttgttattcaactaactcgtgctgtttgaaagctgacagccagctatacgggctgttttataagatgaaccaactattgccgccgggatgggggtgggtcgttatcatagacgagtacaacgcggaatcgatgatttgaattaatcgattgccgttacggtgacagcgacgacatcgccaatgcttttgtggagttttgcacgaatatccttacgaatacctaagatataacaaatactaccatcaaggtttttaacacccatattaacgatagaaccgttgtaagggacctcatcgaaagtggcatggactttgacgcgccccttaccgaaaaggtcgcgaatatcgaagggacaggccacgtaagccccacctttgccaattgttgcggcttgaatcggtgcgtcaaattgataagtcttcattattatatgacctccgcctaagcgtaattatggaacggcttcatttttataatcagatttccatattatcatagcaaattagcaattgttggtgaactaagtggtcactcacaactaattataattaaggtgaaccgctatttgcgtgaaatattaaccgggtatatcgttggtatcaaaaatatttatcgaaaagtacaattattatactaaatccccttgcgagcggggcaatcaaccgcttataattaaactgctttaagtaaattaaaaaagggtgtttacatgaattttaaatcacaaaatccaattgatgcaagtcagtcggaaagattcaagctttataagtcggggaaactttggctggttgctggattaactttcttctcatttttaggaggttccgttcttaacaatacaaacgtgcacgctgatgctacaaatgcaacgacaacatcgtcttcagctgcaagcacggcctctagtgcaagtgttgcaacgagctctgctgctagcgatgcgacgactaaagcgacctcagtttcgtcaagtgctgcgactcaagtaacgagtgcggcaacaactaagacgaccagtcaagcagcgacggcatcgtcgagtgcggccactagccaatcgaccagtacagcatctagctcgactagtcaagcaactaagacggcttcgagtgcagccactagtacttctgcaacggctacaagccaagcaaccagtgtcgcttctagtacggcaaccactactcaagtaagtcataccgcaagcagtactgctgccagtgctgcttcaagtactgcaacggtcaaggctgttaaggccgcttcaagtacggtaagtagtgcggcgacgaccgctactaaagccacagctaaagttgctgccgttgcttataccgcagcaacgacgtcttcaacggatgtctggacgattggggatacgactcggccacgcgttgatgttgttgacgtggcgtcatatcaaagtaccatgacgcaatctgatttcaataagttaaaggctgcgggtgttaagacggtcatcgttaagtcgactgaaggcactgattacacgaacccagctgcactgaaccaagcaaagatggctaacaaagctggcttgaacgttgatttctaccactatgcaacgtttagcacggctgatgcggctaaatctgaagcgactaacatggctggtttcttagttaagaacaatgtttcaaccaaagttctcttgttcgctgacatggaagattcatcttcatactcagttaacgcaacggcgaacttgaacgcgttctggtcaacgttagattcctttggttacaagaatcacggcgtttatacgtccaactcatacttatatcgggatgctgttgttaagacagttggccaatcacgtgtatggcgggcccaatacccatacacgccttctgctaataacctttggaacaccaatgatggtgcatggcaattctccgatacggcactcttaccatctggttcagattataccggttacattgatgtcagcatcgattacaatggtttaactgaagatagtgccgggaccaatacattcgtaacgacaactagtagcaatgatacgacgactagtgaagtaacgactgacactagtgctacgaccaatacgtcaactagttcaacgactaagaaggcctctggttggtatacctttaccaagaacacagccatcaagagcgctgccagtgacagtgctaaaaccgttggaacttatagcaagggtaaccgcgtttactataatgctgaagttacaactaatggtgaaacttggttacgttacttaagttacagtggtagcgaacattttgttaagattgccgcagctaaaacgaccacgactaagcctgccgcaagcactagcaagacggttaccaagaatgaaactggcacttacaagtttactaaaacgacagctatcaagggctcagttagtgactcagctaagactttagggacttactacaagggtgacacggtttattacaatgccaaggttactaagaatggtgaaacttggctccgttacctgagttacagtggtgcgcaacactacgttaagatcagtggtgcagctacgtcaacgactaccaccaagccagctactagttctagcaagacggtcactaaggctgaaactgggacttacaagtttactggcaccacggccatcaagggttcagttaatgattcagccaagactttagggacttactacaagggtgatacggtttattacaacgccaaagtcactaagaacggccaaacttggcttcgttacttgagttacagtggtgcgcaacactacgttaagattagtggtgcagccacaacaacgacgacgtcaagcaagtcaacggctacggctagtgctaagacagttgcgcaaagcgggacttacaagtttgctaagacgactgccatcaagtcttcagcaagtgacgccgcgtcaactgttgggacttactacaaaggcaatacggtcaattacaatgccaaagtaacgactaacggtcaaacttggttacgttacacgagttacagtggtgcgcaacactacgttaaggtcagtggcggtgctgcaacgaccacgtcatcttcagcaagtaagacgacggaggctgctggtacgtacacgttcaagaccacaacgaatattcggaccgctgctagtctaaatgcctcagttgttggccaatactacgcgggcgaatccgtttattatatcggaacggtttctgcggacggctatcaatggctgaagtacttatctaactctggtgcttaccattacgttgctaagattggctaacaattagttaccaattactagtgcaataacaaaacaggctttgagatcacgtcaagcgacgcgatttcaaagcctgttttgttgtgtgattgagttagtggcctgttcatcttattttgacaaaagtcggcatagacgcacttgacaaaaagtttatactgattcgaacttctttcagtgggcctaagctggtagcttttgacactaaaagtttgaaacatgcttcgtattcaagcacgtgtaatcggtgttgtagtgaggggctaatgtttataaaacaactaagccgccagcaccgttgtcgtagtcaggtttctgagcagtgacaaccagtttttcgttaacaaaggccattaagcccaggctgcttaactcgcgaccgtagccggagcccttgacgccaccaaatggtagttctggtaaggagctgaggaaggtgttaacgaagaccatcccagtttcaatttgttgggcaaccgctttgccatgcgccgcagttccggcgaagacgatgccacctaagcccagttcagagttgttggctaaatcgatagctgcttgttcagaatcaactttgaagacttgggcaactggaccgaacatttcttcgtaaaagagggggttgtcttgatcaatgtccgttaagatggttggttggaagaattggccaggtaagtcgattggttcgttgccataagcaacggttgcaccaccggcaatggcccggtcaacttggtcttgtagcttttccttagcgcgtttggaattcatcggtgccagggtagtttgtgggtccataggatcgccagggactaatttggcaaaacgttccttcaactttgctaagaaatcatcgtacacatccgcagcgacaataaagcgttttgatgaggtgcagacttgcccagcgttgtataaccggacccgccatgctaagttgactgcttcgtcaatatcagcatccgctaagacgacgaaagcgtccgaaccacctaattccatagaactcttcttcaagtttgcaccggccgctttggcaaccgcttgtccaccacgcttagaaccagtcagtgcgacgccctggatgcgggggtcggcaataatatcgctaacttgatcatagtttaagaagaggtttgttagactaccagcgggagcaccagcttcttcgacaatcttggcgaaggccgcagccgatcccggtgtattagaggcgtgctttaaaatcattggattgccgaccatgtagttcggtgcgaagacccgcatgatttggtagtatgggaagttccaaggttcgaccaacatcaggacaccggttgcttgtttttcaatttcggcatcgcccgttgcttgagtgctgattggggtcggtgccaataattcagcaccgtgatcagcatagtaatcagcaatcatggcgcatagttcgacttcaccttgagattcactcagtaatttacccatgtcgattgttgcaattttagctaattcatctttatgttcacgtaacagtgcggcaatcttatggaggctggctgcacgggaactaacgggttcatgacgccattggtgataaagggcgtcgccggtagttaaggcctgttcgatttggtcagtggttgcgttgtcgtaagttttaacaacttcattggtatatggattaattgtttgataagccatagtaaactcctcctataaatgttcaggtattgtaaacggttaatctgcgattgtatgggactggtaaccgccttcactattgtacgctaccacaaaagtacggacaaagtcagctaatttgacttgaccagcgctagtgtcagaagcatttagatctgcataaagtccttcaggttcgcgctgataacgactagtttggactaatgaagcggcaattttaacgggaacaccgtggttcgtcaagttagcttgatattgttcatctgagatttgtacccattgtagatcgggcatgtttaaggcgtcgcgcagatcagcaacgaattggtcaccggtgaacgtatcactgaaggcatacttgacggtgataccggctggcgtgtgatcaattaggggataaacgacactggcaatgtcctcgggcgcaacgtatttttgtgctgaagcagcaggcgtgctggaataaattttatgttcagccttgattgttgctaagttaccgaacaagttagcataaaatccggttggacggacaaaagccaggttaaccccgtcaagttgtcgtaattcatgttcaattaagttgtaagcatgcagcgagccagccacttcatcggcatctgcgccgatgctactgaggttgacgacgttggtgacgccggcattttcaattgcctgtttccaaattttagcctgagccacggccccttcgaagggatcatcaccgataccaccagaaagcatgagataaaccacatctttgtcagtaaaagtggtggataagaaatcaacatcagtcattgtaccaatggcggcatgggcgccgacagcttcaattgaagcttggcgcttaggactagttgagataacggtgacgtcatgaccggcttggacgagcttaggaacaacgatccgattaatgtttcctaatgaacctaacattgcaattttcataattatagaacctctttaaaatttgatttttatttttaaaagataaatctatctttcaacgattactagtttaaaagataaatctatctttgtcaagcttgaaaaagatatttttatcttttatactgaagacatgaagaaaaaagatatgaacaaacaagttaagattcaagatgcggttacggctatcattctcgctgagggtccagccggggtttcaacgactaaggtggctaagcgcgtcggcattgcacaatccaatgtttatctctactttaagaataaacaggctctgatcgatagtgtctatgcgcgtgagacgaaccgaattcttagtactaccgacttagaccgattaagtgattcaacaatcgatgtgacgactcggattcgattatatgtacagcaggtgtatgactattcgttagccaatccagatagcttgacgatcattcaacagatcaaggcattgaatggacaggggatgacgatttcggcggcggatgccgatccgaataatattgtcgctaacttattaacggcggctatcgatgctaaggtgattaagcagttaccggttagtttgcatatgggggtcgtgttttcaactattcatacgcatacgacgaatatcagtaagggacggtatgctcaggaccaatatacatttggtgatattttccaaatgatttgggacgcgatgaaacaagattaggaggtttaatgacaaaagacgcgacttaattgataggcacgagtggatatcaattaggtcgcgtctttttttgcgttcatgtagcgattagtcgtcttgaaatgacggtttagtatcttaaaggctggttgaataattcggttcattgtgtattcttttcaagtgtcggtgagtgttttaaactgtaggtaccagtttgagcaaccaatatgtaagggggactttgatggtacagtgggcaaaacgattcagtgaaacgaaggaaccggttgtattgattagtcataatcaaaataggtgtgccggcaaaatagtggtgttaatgatgagtaggctggagttgtggggtagctgatgaagattatttttgtgcaaacgctgttcctattcttgtttgttaaggtgcttttgcgtgattggcgggtacttagtatttgggatatcagttatgcggtggtcagtagcctagtgagcggctggattttttcagtaatcgggcaatatgcagcattgccattattgggactggtggtgctgtttacttggtggcatacacatagcttcagtgagtcattatttgttagcctacaggtgattatctggtcaattgtcgtcgatcatatcagttcacttttaacgtatatgttgaaattagatgacgggtatcttttgatttttatgggattacagctggttggtttaatcacattgaatctgattttaatgaatacgcatatccagacgacattcaatcgtcccagactgaaccgggttacggccttgctgctactcgccatctatttatacattattgtcagcgagggcctcgacagtgaattgagaatggtcgtcagtaacttagttgtgttgttggtcgttatggggctcgcgattgccatctatgatgagtatcgggttacgattcgggccaagtaccaggttcaacaacaacgcctgcaaatcaaaaatgatacacggtacatgcatgaaatcgaaacgcattataatgaattgcgccggtttcgtcatgattatcagaatataatgttgtcgattaatgagtatttgaaaacggatgatttggcaggcttacagcaatattaccaacaaaatattgccccagtgaccaagcgcgtttcggatgagcagtataatctcgaagatttaagtcgtgttcaggtcaaatcggtcaagagtattctatttagcaaactcagctatgcgcaatcacagggagttaaagttcaatttgacttgaagcaagtgcttaatggggtaacgacgaatgaattagacttggcaattgcgctaggtattattttagataacgcgattgaagccacggccggtcactatcacggtgagctgatgagcgccatttttgttacggcccacagtacggtgttcttagttcaaaataacgtttttgattccttgccacctttatggcagctaaaggaagcggggtattcgactaagggacaagagcggggcttaggcttgagtcagctcagcgcaattgttaatcgaaatgaaaatatgatattggaaacgcggttattggcctcagcctttgttcagcgtttaacggtaaagcgggaatgataaaatgatcaaagtatatatttgtgaagatgatactaaacagttacaaaccttgcagcaactggtcagtaaagtgattattgatcgtcaattggatatgggatttggcctaacgagtgccgatccgcatgaaatattagcgcatgtcaaaagtcagcaaccaactcaagccgtctttcttttagatattgcgttgaattcggatattaatggcattcagcttgccagtcaaattcgtgatttaggcatccgaagtaagattatctttgtgacgacgcatacggagctatcattgacggtgtttcagtatcaagtggaagccctggattttatcttgaaggattttccagatcgcttatacgagcgattaaataccgtcttacgcgtggcacaggagcgtttcaaagctgaagacaatgatcaaaatagttatatccaaatcaaaattggcgagacgattcgatcgttggacgtgcaacacgtgttattttttgaaagttcaatgagtccacataagattatcgttcatttagatgatggtgaacttgaatattacggtttattaaaggatgtgccggatttgaattctgatttttatcgttgtcataagtcatatgtcgttaatctgacccgcattcggtcattggataaacggtatcgtcaactaacgatggctaacggtgaaaccgtcctgtgttccgcagcggccagtcgctacttagtaaggcagattggcaaaaacaatcgctgattgaaatcttagtcgatttatattgacggcagtaaaattcagattggcaagattcggtttgctaactagtaaaataatcgtttcagcaatttgatttccctgaaacggttatttttttacgctttattcaggtgtattgaattatgaacctgagctgggccgttccaatcaattcgcttgcgtttattttgaacttatcttcaatgggccaaataaggtcttaatgtagtgtaatggttagtccgcctgtcttaaaacggccgttgcgacgggctacactaaattataattagaggcaaccagtttgaatcaagtgggttatgttcgccacaagtacggctgttaattatgatcaaggttggcttgccattatttcgcaggtcaaatcgtcgtactggacatgggttgtctgtgatttgagcgtgacttgtgattggtcactaacgataatattggtgattagtcgtaataacttaagtgtgggagtgaatagaatgtgtggattggttgggtgcttaacggatcggcgaaaagttgataatgccgcgtatgatcaggttgtgcgggaaatgactaaaatgattgtgcatcggggtccggatgatgaggggtactttgcggatgataatatcacgatggggtttcgccgattaagtattattgatttggcaggtggtcatcaaccgctgtcatatgataatgaacgttattggctaacgtttaacggtgagatttataactacgttgagctacgtgaacagttaattcaagaaggctacacgtttaagacggattccgattcggaagtgatcttagggatgtacgccaaataccaggccaagttgacgacctatctgcggggaatgtttgcctttgtaatctgggataagcaggaaaaaacgttattcgcggcgcgtgaccaatttggaatcaaaccgttttattatgcgattgccggggatgatttttactatgcgtctgagagtaaggcgatttataagattttaaaagataagcattttgatcaagaggcattacaagattatttgacgttccaatatgtgccggaaactgagaccctgacaaaggaaatcaagatgctggcgccgggctgttcattaacaaaacagttgggacacgcgccgcaaatcaagcgttattatcatcgggagtttcatccagtcgtccgttctgaacaggactacgcgacacggcttaaggagacgttgattgattcggttaagatccatatgcgttccgatgtcccagttggggcgttcttatcgggcgggattgattcgtcaattgtggtggcgattgccaagcagttcaatccaaatctcaagacgatctcggtgggctttgaacgacctggctatagtgaattagacgtcgcacaggaaacggctgctaagttgaatgtcgataacgtccaaatgaccatcacgccggaagcattcatggcagcctttccacattttgtctggagcatggatgatccgttagctgatccggccgctgtcccgcagtatttcttgactaaggaagccgtcaagcacgttaaagtttgtctcaccggtgaaggggctgatgaactttttggcgggtatacgatttatcatgaacccgaatccttgaaagcctttcggtatacgaagccaatcaacggggcccttcaacggatagccgcgatgatgccagcaggaatgcggggtcgttcgttgcttatgcgggggacgacaccgttagagaagcgatacgttggcaatgcgtttatcttcaatgaaactgagaagcaacagttcatgaagcactacaatcgtgaccattcgttccaacagacaacccgggtattttacgatgaagccaagcattatgatttaatctctaagatgcaatttatcgatatgcacacgtggttaaatggtgatttgttgcataatgcggaccggacagcgttagcccacagccttgaattgcggacaccctttgttgatcgggaggtgttcaatctggcagcggaaattccagccaacttgcgaattagccacggtacgacgaagtacattttacgaaaagcggttgaagatattgtacccgcgcacgtgttatatcgcaaaaagcttggtttcccagtaccgattcggttgtggctcaaagatgagatgtacgattgggctaaaaatattattgtgacgtcgcaaaccgatcagtattttgacaagacatatttcttaaaactattggatgaccatcgagcgggtattcgtgataattcgcgtcaattgtggaccgtgctgaccttcatgatgtggcataagttatacgtggaagctgatatgttaatggatagtgtaacggccaatcatcttgctgagcaagtcgaaatcggttaagctgttcatattaaagctaaataagaactcgttcaacgtgccaatgagaataaaaatcatccagcgacctgattgtcttaatacaaataggttgctggatgatttattttggtggttttgtagttgtttcgttagtcgatgacgactttagtgccatacttgatgttgttatagacccacttggaatctgcaacgctcagatgaatgcaaccgtgtgaagacggtcgcttgccaagatcagcagcgtctgatttgataaagtgaccttgggcatctacgggtgtggagtggaacaaatattcaccatggttgagccatgagacccagtaataggcaccttcatcaacactagcgctataaaaatattttccccgttcggcttgcacatgataggtgccacggggtgttttgcggtcagcagttggcacgccactggatgcatacattgtaaagagaacgtggtgatggttcatcaagtatagccgttgtttagccaacgatacgtgaatccataagtccggatagcggttgacattgggatacgcgactgtttcggatgattgacgccagttgattggtgtgcgcatgaccgttgatttagccgtggttttggctttcgtctttgacacgacttttttggtggttaccgttgattggctaggtctgtgggcatcaccaacaactttgacagtgccgactgccagtaagccgataactaaagtgatgctagttaataaaattaatgttgatttgcgttgcatgttgcgcccccatagttggttggttctgtctggctctgacttgatagttagtggtaatagtcaatactgaccattcaatcaggaccttctcagtaaaagtggaaaccaatcgtatattaccgttatagctttctgaaagtgaaaatgcaacccagtcgaatgctgggtaagtcggttttacgaacaaatcggggtcgcaatggcgtaaagcgggcatattcgggctttaagtcaattaagacagcctaaaatggcaataattagtcttcaaataacactgaaaataaacaataaatcccaactaaaagtaggaaggctgccggtgaaaatcgggacgattcattgctaacattccgagtcgcctcctaatgaggttcctgaactagtgacggttaagtggatttaaaagatagtgacataaagaaaaacactcagcctagcgataggacaaccgaattggcggtcattgttaagccgctaagcttagtgttttcgatgaccgtttaagacgactacgggtcatttagctattaattttgaacgcaatgccggtcggtgctttttgcgggccgcgctaaccaaattagacctaacaataggactaagctaacagcaaccatgatggcaccaaagatcggtgtccagcctaagccaaggttggtcgtgacttgaccaccaataccggagccgagtgcgataccgacgttaaaagcggaaatatttaacgctgaggccatcgtaatatcgtgtggtgtattctgttcagctaactgaacaatatagagttggagcccagggacgttcatgaaggcaaagattcccatcagtaggacggtcaatagccctagccagtgactgtacccggtgacgcttagaatgagtaaggtgatgagtaacccactgaacatcttgaatagtgcaattaagggccgtgcattggcccaacgaccacccagtgtattaccaagggcgaccattaagccgtaaacgactagaatcaaaacgacagcgctcgctgaccaatgcatctgctgttctagtagtggtgataggtaggtgtaaactacgaaggtaccaccgtatcccagcgccgtgacgagtaaggcgaacagtagttgtggattagtgagtacgcggataatcccccggaccgtggctttactgggtaacggcagattacgtggaattaaccagtaatcagctaacaaaccaatgacaccaatcatgctaataaagataaaggaccagcgccaaccgcctaattgaccaatcatcgttcccaacggaacaccagtaaccgttgcgacagtcagtcctgtaaacatgatggcaatcgccgaggcccgtttggcaggtgcgaccacgtcagcggcaattactgaggcgacggtcataaaaataccgtgagccaaagcggccacgacccggcctgcaagtaagacaccaaaggttggggcacttgctgcgagtaagttaccaataataaataaaatcataattaacatcatcaagcggtgacggttaagccgaccggtgagtaatgtcatgacgggcgcgccaatcatgataccaatggcatagatcgagacggtcagcccagcttgcgccaagttgatgtgaaagttgctaacgagtagtggcattaaaccaacactaataaattccgttgacccaatggcgaaggcactgattgcgagtgcaaaaagtgtccaactgggattaaactgttttgtcataagataagcctcctgctattgctaagttgataaataatgattatactagcaagtgacttttagacaagtaccgactttaaagtgggatacccactaaaaagtaagtatggaatggagggacaattattggaaaccaaaacgtatcatattggggtcgaggccacaatggaaattattgggggtaagtggaaatcaattattctgtgccatctgcgtactcagacgatgcggacgagcgaattggaacgggcgattccacaaatctcgcagaaaatgttagtacaacaacttagagagttggaagccgctaatattgtgacgcgtaaagtgtaccaacaagtgccaccgcgcgtggaatacggactaagtgattatggccggagtttgtccgttgtcttacatgagctgtgcgtgtggggtgaggataatattgatcgccgccgagctgcgggtgaagagattgccttgttacatcgagacgatttatagacaatgagtttaaattaaaaatggtgcgtcaagaatgaaaatattctggcgcaccatttttgattagggggagttaatgttgggtcggttgacgacgattagacagtaaactgtaaccaaaccagctgactgtgatgatagcctggatgatctgtagtccaatgccccaaggattcggcaaaaagatgaatacccaagaaccaaaacgtggcgtaactaggaagagtccaatcagcataattagggtcaaagtggttattaaaacaaccggaacggtttcctgcttaaatggcgtactatcagcataaatcgcatgattcatgattttaaaaatcagtgctatggcgataatctcgactagtggggcggcgaaaagaagtaaccagttcagacgaaatcctgttgccgtattagcatttaatataacgaagaaccagctaatcaggattaacaggccaacaaagtgaatttgttgccagcgactgttgcgcggtaattcggctaggagtgcatctgcgagcccagcaggatcgttaccaaaaaattgtgaggccgtttcaccatgctggctggcgtctaggaagtcttgtaacatcgtcaaaagttggcgtgtaatggctttttcattgcttccgaacagttctttggtcagcaaataaaggcgtaaatcttggaagtattgcgcgtcactaagggtgagttgttgttcaagttgattgagctgtgcctggtcattatcaattttggtcatgatggggtcctcctcgttaagatgtgatcgacatgcgcttttaactgaaaccactggtgattaaaagctgttagtgtttgtaaaccttgaggggtaatggcatagtattttcgctggggaccatcaggagaagctttgaattgcccaatgagatcgccgcgattttccagttttgcaagtaggggataaagtgtgccaccaacgattgagtcaaagccgtcttcacgtaacgcctgaatcaattcataaccgtaaatttcatggtctgaaataatggccaatacacacccgtcgagcacacctttgagcaattgtgtttgtttcaactagtaatctcctttaactagatagtattactacctagtagtataagtgttaatcgccaaatcggcaataaccagatttggtttgaaaacttaatattagtagtaatgactccgcttacatttttaaacagttatgataagcttagattattgacgataaatagactggagttggtgagtatgacgaaggcagttatttttgatttagatggattattgattgatagcgaggttatttcattaaagatgtatcaacgaatcgtacaggattatgggcagacgctttccatggcgacttatgcacaggaatacagtggtaagtcggcggtgacgaatatgcaacacttgattgaacgttttgacttgccatttaatgttgatactggattaaagcgggcgttaacgttggaaaagacgtttatgcaggatggcgttgagctcaaaccgggagcacgggtgttgttacagtttttacaccggaatcattatttagtggccttagcttcatctagtatcaagtcgcgggcattagacattttgacgtcccatgatgtggcgcaatatttcgaccagtttaccttcggaccggatgtcgatcgtggtaagccatatccagatatatttttgatggcatgcgccaaactccaacaacaacctgcagattgtttggttctggaagacagtgaagctggcattcaagcggcgacgtccgcgaagattccggtaatttgtgtgccggatatgaaacggcctaaccagccctatgctgatcaggcgactgcgattgtaccgtcgttaacggatgtgataacgcatttaaaatcagttcgataagattcagttgtaattaaaacataaagattattaaattattaataaggagcggttgtccgatagaaaaactgctatactacgaggcgtaaataaatcgctgacaagttagccagtggaacgaaggagtcttgatcaatgaagaaattgatgattgctgtaactggtttagccatggtggcaacgctgggagcagcggtacccgttacagggattacagcgaatgcggcgactaagaagacaacggctacgaagaatgtcgcaccaagtttgaaggtcaatgcaatttacaataatacgacgcaaattacaggtacggcaaccaagggcgctaagatcactgtaaaaagtacggccaacgccaagaaaaatcttggaactgcaacggcctctaaaacgactggaaagtacacggttaaattagccaagacattgaaggcgcaaagcaatgtttatgtgtacgccacgaatccaacgactaaggcttatttctaccgcgtcatccgtgttcagactgccaaaactactgcctcttcaactaagaagacgactaacaagacaaccacgactaagaaagtggcaactaaatcgacggcggccacttcgtcatccaagaagacgactaaatcgtttaaagtcaacgcgccagcgggtacttggaagtcgaatacgactaacaagtactcccaaatcttaacgtttagcgctaagaatggatttaatcagacgctttataagaatggcaaacaagttaaaaagctggtctcgtatgcgagttatagcatgactgccaagacgccaacgttctggaaagtcagctataagtcaggctcgactactaagaccctatatttacgctatacagcaaccaataagtttacggttgttaatgctaaaaatcagatcgttaaagttaaggttggcaatgccccagcagctgtttggatgtttaccaagaagtgacgggtcgttaaatatcttaagtacgaacaattcctcagcattttgaggaattgtttttttgtcgtttgctgatcaattagattgaatgtggcctagtgaatattaaaataattgaagaaaacgcagatagcttatcgtcattagcaggttaggtgagaacatataaattggccaatttgggctgttcatagtggtcatgatggaaaagacactacagtgttggtaggtcatctagttcgctcgaagaatggcttggtcgtgagtcacttcaaaaatgaccatcgtgcagttgtatccatgaagaatactgaataaacaagtaaatgaaaatggatgttcgttagctgatacttatcatttaattacggttattaacgcaaatgatatcacggtgataaaaaattaatattcggatatctgtaaaattgtaagtctttttctgaacgtcacaaactgaaaataatgtaagataattaacgtcaagagatgttaaaatactatctatgtgaagggagcgatgggcatgcaacaccggcaattatggtatcggggcggcctaggactggcattagcactagttgtggtcggatatcgtggatcacggacagttattcgggcggttccccgcgcacaattgagtgttgatcagaaaatgccatcgactagcagtgttttttctgcttcgaaattgacgttgcaagatgcggcaaacaactcggcaccacaagtgtcacctgaggcccaggaaagttcgggacctgacaagcagtcggatttaacatcaggcagtagtaccagtagcagtggtatcagtagtggcaatagcagtggtagtacaatactggaaaacactaaaaataatcaaacatcagaaacggcgacgaccaaagcggcagaaatggtcaatgggacggttaaaatgaccttagatactaatggcacattgcatttgagtggtgggtcatttggtgcatcgctagggtcagccacggggagttggattgtaaaaaccttgacggctaacggctatcaaccgacccaagtttcaaagatcgtcatcgacggtaagataacggcaactactatgactaattattcatatctgtttgctaacttacctaatgttacggcgattgatgggctagccaaccttaatttaactggcgtaacggatatctcgtggctatttttgaactgttcacagttaggcgcgttggacttgaatagttgggatgtcagcagcgtcatcagaatggagggaacgtttcaaaattgtgccaagttagttacgttgaatgttgccaattggaacacggattcattacagtatctaattgacactttcaatggtgacagttcattaacgtcgttaccagttggcaagtggaataccagtaaagtggcgacgatgatgcgaacatttacggattgttcttcgctgacgtcattagacatcgctaattgggacacccgtgtcgtaacgaacatgtccgcgatttttagaggaatgtcgaaggttaagagtttacccattgataagtggcaaacgggccgcgtggttaatatgcagttagtcttttcaggtgatactagcttggaaagtattaacgtcgctaattgggatacgagtcgggccactgcgttggatgggacttttgctaagcttcctaatatcaagtccctgccactcgacaactggaatacaagtaacgttcaaacgatacggagcacgttttatggcgatactaacttgacccagctgccgattgacaactggaatgtcggcaaagtctttgattttaattcaaccttcagtggctgtgccagtttaacaactgcaccggttgcgaattggaacacccagagtgccaccaatcttggttatacttttgagggcatgactagtctcacctcgttaccagtagataattggcagactggtactgtcacgaatatggccggaactttttctggagttagtcagttaaagagtctcccgattagtaagtggaatacgaagaatgtacaaaatatggcggggactttttctaaaatgagtagtgtcacggcattaccagtagataattggcagactggtaatgtgacgacaatgaggggaatctttaccaaagttagccaagttaagaatttgccagttggtaagtggaatacggcgaaggtcgttgacatgggacaagtattttacggcaacccccagttaactagtctgcccattgaaaactggaatacaagttcagccacggatttttcacagctatttgcggaagattcgggtttacaaaacttgagtctaggtgcttggaatacgaccaaagtgactaactttgaatcagttttccaaaataccagtctagacaaattagatttgactggctggaataccaacagtgcgcaaacttataccaacgctttcagttcgaagttgccgcctaaacgtctattgttgggccccagttttaacttttttaagagtgaaagttggcacttgccaaatcctagtagtgaggcaccttatattgggaaatggcgtagtttaaataataaaaaagtttatacgtcagctgatttgatgactaaatacgatggcaaaaccattgttggagaattcgaatgggccactggcaacacgattacagtgaagtatgtggacgctgctggcaagtccttggcacccgacacgaaaatcagtggtgcaactggtgatgcctatcatattaaaccaattgagattcaagggtacgtgccagatcaaccagatggggttcaagggaattttaccgacaaagatgaaacgattacattaatgtacagtcctggaggactaatgtttgcctcagcaccgcagaccattaattttggtcagaatccgattactggtaaatcagaaaattacggtgcctcctatgatactgggctagttattcaagatggccggtcaataggttcaacgtggtcgctcaatgcaacgctctcagcatcaggcttcactagtaagcagtcggcacgaccattagcggctgtgctcagttataaggatcaacaaacgggtggcgagtcaattcttacgccaggtgtggcacggttgatcgtcaataaccatcaaactgtttcgaaccaaggcgtcaatatcctcggtcagaaaacggcacttggggcactatcgttacaagtgccaaccgatcgtgccttgacggatacgtatcaggcgacggtcacttggacgcttaatcaaggggttcctaatcgatgatgaaaaaaataatggttaggtaacataaaatttgtaagactgcttgattgttgttagtaagttagttatgtatatttacaatgtaccacaataactattctagcttaatgattggtttcggccagggttggttttagttatgccgcaaataatgatatagaggaggagtggtgttgatgaagcgtttggggttcatcacaattgccatcagtaccctactttgttgggggtggttgtcagcaccgattattggtgtggctagtacggctgagagcccagcaacgattcgtttcgacggccaggctgagtcatcgaactcagacactggcgctaatcagttacaggtgactgaagcgtcaaagtcgagtcattcgattgtgcatcagccgaatgctagtcaagctgttcatcatcagaacccggggtggttaccacaaacgagtgaacaatggtggctgagtgctttcattggtggtattgggttattggtcgttttaattggttggcaattggttaactatctaaaaaaaaggagttcattatcatgaaaaaaacattattaggacttttattctcagcagcattgattgcaacatcaggtttgaccgcgagtgcggccgatacgccacaaacgtctaatgggacagttggtttcactgggggcgacatcactattgataatggtgatacggacttagctggtgctagtcttgactttggtaccaaccaaatcaccgcagctaacaaagacgataactatgacaacacgaataagtcagcagcggtatccgttgtggacttacggggaacggctgctggttgggatttacgtgtgaagcaaaatgacgtttttaaaaacgacaaagcggttgctaataaagaattgacgggtgcgattctaacattgaatggtgttttggattcaaatgcatcgacgactggtgcggacgcaacggccaataccggtgttgcgctagatacactcaatagtgacaaggttttgatgaccgccgctgtgggtaaggggaatggtaagaacgtggctgatattgctaagtcacaactaatggttcccaagactacggcacgagctacgggaagttatagtacaacgttaacttggagcttgaatactgcaccagcgaatagctaataagtattgatcggaaaaataatggctagtaggggttaatgtcatttttccgaatcatgattagggggagaaatgatgttaacaaagagatggtggcagttaggaattggtttgctagtcggattagttagtctaagctggggacgaacgggttcggctaacacagtcggttttgaggtcgcaccggtggcttccaaatatcaaatcgataaggctgtttcatactatgatctgaaactaaagcctagccaaacaaccactttggcagtgaaagtgacgaacacaagtactcaggaaatcaccgtgcatacggcaattgtaccggcgacaactaatcccaatggggtggttgagtatcaggcaacggctgatggcaagaacattgatttgccagctgatgctagtcaactgattacgacggcggcgaataagattacccttgctaagggaaccagtaagatcgtgacttttaaggtgaaaatgccggctcagaagtatgatggtgttgtcgttggtggactgagtttcttaaaaaaggccgccaaacaacagagtaagagcgcaatggcgattaagaatcaatacgcttactcagtggcggtcgtattgcatggtgaccacgcgctcaccaagaacaagttgacattgggtaagattgatgcgacgcaaaataacgggtataaccaaattagtttacccctacaaaatcgaacggccgctttcttgaatcaagtcaaaactgatgtccaaatctatcgtcgtggtagtaacaaagtgcgctacaagcaggtcaatgaacacggtcaaatggcgcctaattcagtttatgccttaccgttacgggttggccgggatgcgttgaaacccggccaatataccgctaagttggccgtgacgtccaaaaagcaacattggacgttcaccaaagattttgaaatcacgcgtgatcgtgcgaaccaactcaacaaaaccgccgtgattgaacatcatactaactgggggttgtggatcagcctcggtctgctagtcatcttgttgttactgattgcttggtacattcatcgcaagcagctaaagatcaagcgattagaagaacggcttaaagataaatcataaattcatagccattagtactgttataaacggactcggtcaggttggccgagtcttttttgtgggttcggtggcaatgaatataaatttacctttgctaacttaatcattatctttttgcaggcaatgcgcagcggcttgtttctaagtataatgaaagtgtagttaacttaaaggatgtgaataaagatgaagtatgaatggcgtaaacaagaaaaaacaacctatgctactaagaagcaaccccaactgttgacgattccagcccaaacttttatgagtatccatggaacggggaatcccaatggcccagagtttcagacgcacctgcaaacgttatatccagctgcttatgggctcaagcatgcgtataagcagtatgcgcaaacacaggcgtgtgaatttgatgattacgttgtttttccgcttgaaggggtctggtcattgacgattaagggacagcaacttgaccatcttgacaaagatgagttcagttatgacattatgattcgggtcccagactttgttcccaatgaactgattgcaccggctttggcagcggttaaagctaagaaacaactgccaactgaacaaattaacgtgcagcagttcgacgcaatgcaagtggcacagattctgcacctgggtgcttatgacgatgaacccgcgagttttgccaagatagatgaactggtcgccaatcaggggatgcatcgtactagcaagattcatcgagaaatttatttatccgatgcacggcgggtggcacctgataaactgaaaaccattctccgatatcgagtggcgtcgaattaatgcgaaaacttttgactggcattgggcgtgaagcacgaatataatttaattatattttaactcatataaaattataattaaggggtgctgatagtatgacgcaaatagagattagtgatcggctgaaagctttattggttgcgaagggctttgataagaagcaattggttttggtgacggatgatggtggtggcaagtactctttgcacggaggtgcttgcagtattggaactaaatttacgataatcgtacttgatcagccggacccggaatacaacgtaacggtggtgaataatcaaagcctcgcgctttggacctccacatacgatctcattttctttaacgatggtattaagatggattacgatcaggggcggatcgctattaaggacaatgcccatatgctggacaatgccgttcaaatcgctaaaggagcggaagttttagctgcttttgaacagggcgtcccagccgacaacctaacttgttaattgcgatatgaagaaggcataataatgaaggcagttatttttgacaattttggtagtcccgatgtattgcgcattgctgacgtgcaacggccggtggcgacaactgcgaccgtcttagtgaaggtcatggcggtggccgttaatcatgttgatacgtttgttcggagtggggcgtttaagacggccctggcagcaccacacgtggcgggacgtgatttagtcggtgaggtcgtagccagttcgcaaccggactttcaaatcggcgaccaagtctggacgaactcaatgggctatgaaggccgaatgggcgcaacggccgagtatgtggcggtgccaactgatcgcttgtatcacgttcctgatggcgtggcgcccatgccactcgtcgcggcggtccattcagctgcaacagccgccatcgtacttaacgacgtcatggaaattcgtcgcggccagacactcctaattgaaggtgccgcgggcaacgttggccgcaagctgattcaacttgcgcatcaaatgggcgtgacggttgtgataaccgcatcaccacgagattttgcacggtgtcagcagctaggtagtaccgcctgttatgattatcacgcggggtttgcggaccagttaacgacggatcagtggacttttgaccatgtgattgatacctcgggacgcgtaccactggcgattaatttagcgttattacgattaggtggtcaggtgacattgattacggcaccgcaggataaccaatttgagttccctgttcgccagttttacatgtctcaacaacgaatcactggttttgtgattagccatgcaacggttgaccagttagcacaagcggccagtcgtttaaaccgagcttttagcgccggactgctattggatgatcaggtcagccagcgatattttaaggatgccgctcagtgtcacgctcaattggaagcaggcacggatcatcaccagcgctttgtgttattaccgagttgattcagcataacgattgaaagcctgattaattaatcagtaatactatgtcaacaatagtattgtaattttggtgatttaaagtgattacttggcaggaggactggacagtcggctcccgcgcgtctaaagttgcgaccaatattatctgtgaaaggaccggcgtgctaacaatccgaaaggtgatcgatacggcgatctttactaatgttaatggcattcctccgtggtaatacgcagacttgaaaagaatatcgatgacgaaagtccaacacttgtcagcaagggttggactttttgtggtgcagcaccagaagcaatggcagaaaaataattaatttactacctatactagattgttgatatgaatttatttattcggatagccatcgattgttggtgaacggctttaaaggaagttcgcctaattatctcaagcaacccaagcttgataacggttacacgaacaatccgggtttgtaaatatagttaacgttatacattattagcgctgttactgaccaaccaatataatgaaaatgtggtcaaaggagtcggcatttaaattaattaatcaatcgtacaaggttattgggggaggtcacaagtgatttagtgccagtaatttatgaattgttatgagagcaatcattgttgataatgaccaccgttcttagttgatgaaagctaaacaagcgctggtaaatgaaaaagggggatttataccatgaagccaatgttaggacacttattaatggcaggaactttattattagcgggtagtacaccgattgttgccaatgctgcagaaaatcgtagtgggaatacggatatcaaagcggaatttacgaagagtacgtccacggtgacgccagttgatccatcaaatcctgatgtgccaagtactgatggcgatggtgacaacggggcggcagcaggtggcgacctgtcgctgatttttgtgtctaaatcgttaggatacgggacgcatgagctggacgttttaaatgatcaacaatataaggttgacccaactagttcatatactttgctatggcaggataagatggttgtagaagtttctgatgttcggggaaccaatgccggctggaaattaacggttaccggctccaatttaacaggaacggatggtacggctgcaaagggcgcaacgctcagtttaccaaaaggtgacgtggtcaacagcggctcggaggccaatggtgcggttgccacggcttccgaagttgctttaaatggtacggtgggatcaagtgccgtcttaaatgccgataagggcggtggttctggggtaactgttagtcgcttagatccaaaggcgttgacactgaatattaaggctaatacggttaaggcgcaggcctatagtgctaacctgaattggacattgagtgatttaccaacaaattaagcgtcatcggggcgaacggcgccccaagtacatatgtgagtaatgggggcgagaagatgcaattattgaagcgaatcatggtcattgtgggaacgttaattttaggcctgcaagttagcagcgttagtggattggcagccagtagcgcaagtagcagtagcggtaaaaccacgcaaagcaatgacatcgggtttagcgtggccgcgaagattccgaataatcagattgatcaacataattcctattttgatttaaaaatgacgcgtggccgacagcaacagattcagacgacgatttataacgtcaccaacgctgacatcaaggttcgaacggcgattcatacggcttatacgaacggcaatggcattatcgagtacgtgacaccaactaaaagttacgatccttctttgaagtatcgaatggaccaaatcactaaaatacagggaccaacgaccatcacgatacccgcaaacgggtcgaaagtggtaacggcgacggtcacgatgcctaagcaagcggtgaacggtgtgattttaggcggttggtattttaaacgggtcgccaataaagtcaccggaagtgttaagggttccatgaatattgccaatcagtattcgtatgtgattggactgaaatatactgctggtatagtgccacaaccacaattgaagctcgatacgattacggcgggcatgcagaattatcggcgaggggtgtttccacaattacgcaacgttactgcggtgatcgtcccaaaactaacgattacggctaggttaacgagtaagaatagtggcaaggtcatcaagaactttacacagaagaatgtgcaattagcacctaactcagtttataaagtaccaattttgacagggaccaatcgtttgcaggctggttcgtatcatgtccggctagttgctaaaaataccgatcatcgatgggtgtttgataaagattttgtcatcagtacggccgcggcagataagtataatcaggcttccgttgataattcgggaatgagcgttggctggtttattctattcggagcgttaggcatgttaattattggattaatcggtctattaatctttttctggatcaaaaagcggcggcgtgcttagttcggtcagtgaaatgggggaaggaccatgccgaataaatggtggcgattaatattaggggtaatgctcgtgctgagctgggcaataccagtgcgggcggcaacacacggtcgcactgagatcagtgtggggttttatgagactaagtatagtgctgaccggattattcccgcccgtgtgattcctgatggtggtcacccgtacgttattagaccagctgacccgggtacccagggtcagagaaatcagtcagagcgcaagccaatccgccgacaactaattatcgatggctggttgcgtgggcaatcacgcaatggtcaacaattgccccaaacgagtgagcggcttgtcattggcagtatccttggtgggatggggttgttagctagtgttttagcaggcgcgttgtaccgaatattaaaacggcaagatgggggtgaacggaatgcgtaacagacgagtaaaatggttactaattcttgtattcggtatactcggcttgctgaatttgctgcccttagagggtaacgccgcgactttgacgagcaagatgacggacgtgaaagctaatgctgcttttcaggccgtaccgggtggtaattcggttggtagtaatgttgataacggtttgcaagcgtatccagcattaggcaatgtgtccgctaactatgcggataatggtcgaattacgaggcagacgacccaaattacaatgacgatgacgggttcgattaccttaaaatctagtaactcgatgtcaaaagcttattttgatattatggctggtccggcaagtgggagctacaccggggcgacattagttacggctacacctactagtcttggcagtggcaattcgattatgattagttcttcaaaacagacgcagacgttatcggtcaattttcaaaatattaaaagtgagttgccaatctatattggcttccgaatcacagtgaatggtgaggaaggtacctatcagctggggcgtttcaacgcgcagacattatctcctaaaattacggggacactttattcgactgatacgacgatcaaaggaaccgggacacccggcaatacgatcagtagtaatgttaatagtgtgacgacgacggtcggaagcgatggaacgtacacgctgaatcttgggactgcactcggtactttaagtaacgtcaccgtcactgaggtcgatgagattaccggtgataaggggacggcgaccgcagcggtgaccctcaaaaaactaaatattactagttcaaagacggcagtcgatctatatcctggtgacttagattcactgacaagtgatagcgcggtcgtcgcctggttagttaagcaagctggcatcgttgcgacaaatccggatagtgcgactgacacaattacttacgcggccgacgagactagtttagcgagcaagttgagtagtttagccgttggtagcagcaccacgatcaatatttatgggaaaggcagttctgggctgaagtcggatgctaaggcaattactgtgacgatgcgggatggaacgttgagtttgggcacattaccagcaagtttgacgtttggcaccctgacgattccgtttaaagaaacactatatcagccgacaaatgcttggaacatcactgttaatgacacacggaagaccggttcacagtggtacttacgggcgacagcaactgccatgaaatccagtacgcggaccatgagtggcaacctgatttatctgaacgcggggaacaaacaggcgctgacgaatacttcggtaacagtcagttctggcaagaaaatcgcgggtacgacgagcactaatgctgcaagtggttggtcgagcagtcagggtattttattggatgtccaacctagtgtgcaaattgacagttacagtgggacgattaattggaccttacaggatacaccttaaaaattaatataagtggttaaaagatattgcaaaagtatgtcgatttgcaatgtctttttttatgaataattaataataagattgtaagggctttattatagtttaatgcaaatttatgtttacaatatagagtaaagggtttaatgaagccgtatttctgatatagtaaagtgaactaacaaatgtattaatatgatgaggtggttggcgtgtcagcagtacttttagcgctgtcgttgatttctggcggttatgaaatgttgtttttaatgattggttttagagaatatgtcacttggcggattgccatcatttggctaagtctggttatcattacgatgagcctgggggaagtggcttcaaacttatggccccaagtccccctggcttatttttggatcatcccgattgtttgtgtgaccacctttatgagttctcggttgttgtacacccagtggattttaatgttaccggtggcaatctttttgaatgcgcttaagcgattagtaggggcaatcatgggtgtcattgccaaggccgtagcccaatctgcatcgccaatgttattacggcaagctataggtctacattcgacagcggatattaatctctttttagcgtcgattatgatgctgccggtcattattattttagggatgttagcgcatcgctggttagtacaagtgtcggccgccgatttcttgcaacgggcgcgtgttaatattagcgattacttattagttattttgttttttgctatttacattattgcgtatgtttttgcgatggaatggtcagtcaatgcgcaaacgtatatggcaattgcggctatcgtgacgtttggcattatcgggtcgtatttaattagtaataaaaacagtcacttgaatgatgcgcagctattgctacaagtctcaaattacaacgaattattaagccaccataaccgtgatttacatttgtttaaacatgattatgagaatattcttttgagcatgtcggcatttattcagaacaatgatatggccggcttaaagcgttattttacaacggaagtaatgcctgccagggtaacccttaatcgtcagtcgggactgagtgatttgagtcgcttggatatgccgacggtcagtggtctgatttatgcaaaatatgaggcagccaacggtcagaacgttcatttagtggtgacaatcttagagaaagtcacgttagcggatattccacagataaaagtagtgcggattttgggtaatttgctggataatgcgacggatgctgctgcccgagcgaatcatcaagtggcgctaactgttaaaaatcgggatgctcacacaacggtattttcgattacaaatcaaattccaacgcatgaagcggtagatttatcagttatcaagaaaagtcgatttacaactaaaccaggacatttgggttatggattgagtagtattgaacaattaactacagatcaattagttgttaattattgtattgaagagggcaactttattgcagagctcattatcaaacattaaactatgattatgaatcgaaaggatctgaatttggtggcattactaacaacattacctaatattgggccaacattagccaaacaattgcaagccgttgcgattacgacacccgaacagctaaagtcaacgggtagcaaagtcgcttttactgccataaaaaaggccaacccccacgcttgtattcaattattgtattcgttacaaggcgcaattgagaattgcgcttacccacagttatcaccggcaactcgcgaagatttaaaacaattttttagatcattgctataactcatgaatggcaatgtgagcgctggtcggagaatttaacgataagcttttagataattaagaccatacttttttcactttatgtgaattggttaacataaaaatgattgctttaaagcggttatcccagattacgagggataaccgcttttgtgtattgattgttaaataaaaaatatttgttagaatcattagtgtacagcgggattagttagcattgtaaattgtcagatggcaaatgtaaatagtattactgctagacatctgttaaaatgagcattatttttgggttaacaaattttgaccaataacgtaaaggagttacagattatggggacagaactacaatttgtacaatatttacatcaaatgcgtgattataatgatcagcacccaaccaccaaggggctgatcttattaggttacttagaacgagattttattcgattttaccgggccggaaagattgaagaaggcattcaatttgctaagaaaaatctgacccgttcgcgcgatttattaaataaattatcgagtgaggaaaaacagctgcaactcagtgcgctggttgatgtcttagcttttgagggaatccaaaatcatgctgagatttatgaatttgttaagctacgtaatgattatcaccgttggttagttaaattacccgtgacgacggaacgttaccagccactagttgtgcagattattcgtgattttgccgcaattgccaaaccgaacgcattagcttataacgcacatttagagtcaacgctcgatgtgatgtactataccaatgctcacctgcatgatcaattatcggtgaaaaaggtattggcccacgtcaatgcgcggtgcaatcctgagtcagtgcggcggtcgtttagtcaagagatgcatatgtcgattcgtgattacatcaatgccaagaaaattcaggaagctgagcatatgttgttggcaacggatttaaccattcgagccattgctgctgaactctgtttctacgatgccgccgatttttcaaaacgattcaagaaggagaccggtcaaacgcccttagaatttcgacaacttaatacacgaactgattagtacttgtatttttaaagataacctttttcgcgtaaatacaaacccccgttttactcgcataaaagcaggtatactatgtctcaaaattcaaaatatgtcgatatttgactaaaattaacagaggcaaattactatgcgatatacacggggcaaatggcgcgtaaccaatcccaaggtttggttgttttctagtgttttaattttaggttggagaattgtgccgacagtggctcaagcaagtgaagctgagacggttaccatgtcgagtcattcggtgcagttagaaacggatagtcaagaccaattaacagaagtagcacggatttcaaaaactgcggtaactcgtgatcgccacagtgtgaccgcccagtccagcaagtcagctgacaggactagttcggagcaatctgctacgactggcactgttgaggcggtcagtccaacgactagtgaagcccaacagcggtcaacacagcaagataaaacagctgttgaacaacaggcaagtgactcaacagcagcttctgcgggtgccagtactaatcaggcgtcagccgcaacaagttctgatcaggcgccagcagccaactcaactggcactcatcatgcgattgatatggccagttcagctagcgcactaggtgctgacagtggggcccattctgaaagtttatctgaggcgcaacgctcaggtggtcaaggtaagacgatcgattcagatttatcagggactgttcattcacagtcatcagtgagtaccgtgacgacagctacccctgtgaactcaaattcaagcctagaaagcgacaagtttgcttccacacggagccgagctgtagcggcaactgatcaaatgagcagcagggttgagaaaagggcattgaataaaacaaatgtcactaagtcaataaacataccagttgcaacaaagcagccgagcaagcaacggacagtcaccgcttcgtcgtttttgacaacagcaaagaacttagccgataagaactatcttgatcagtatgccaaacagcatgggcaagcggctttgattgctttgatccaagattggttgtccacgtatcgaattattgcacttacaggaattacgattgtgaatagttcgtttgatggtagtgtggctacgattagtggtggcttgcacgttatcaatacgggggcgacaattcgttctggtcaggatgatgaatgggagaccatcataaacggtggtttgtcagtgacaaacaatacaatcacgtttacaactaccaatggattggtggaccgtcccgtagctaatcaggatatggattttacgaagcctcggccaacaggaaatggtgcaatcaaaggtttaccgagcgttacggttgattcttcgttaatcaatgcgcaagaatttagtcaagctcagatcaatattagtgacttttatgatcaactagttactgcagggaccattttatcggcaactaatggtggcacgttgagtaagatgctgattggtgagtctggaactgctgatttgggctcttatcaaggacaccattattatgccgtgaatattgatttgaatgactggcacagtggtattcggaccactggttttaataatgatgatgtggttatttataacgtcgtcacggcagcaccagagttaaccattggtggcggtttttctagtagtacaccgaatctagtctggaacttcaatcatgccatgcgtattcagaataccacgatgataactggtaaaatcgtggcaccacatgctgtctttacaactaatcaaaatgttgattcagcggccgttttacaatatggatatggcgatgttgacagtgctattcgagagacgattacgagccaaaacgagcataattatggttttggtcaagtggttactgatgacccgttggattacttaattgcagtgattaagtcggatggtacgagcattgatactttagctggttttcgccatctactagcaaccgggcaactgaagatcacgattacagatgcggctgggacacgtttatcagggttgaatgcagttgatacacatattgcgggccagcatcgctatctaattacttaccaatttggcgatcagactgcaacgacttggttgaacgtccaaccatcgcatgagcccataatacctatcagccggataccggaatattcagcgataacgcggacgatcaattaccaagatgagcgaactggggcggtgcttgctggcccagttatacaaaatgtacgggtcgtgcgatttgccatttttaatgctaaaactcatgaattgctcggctatgatacaaacggcgacggaattgttgatactagtgatgggacaattgcatggctgttagtaccgccaacggatcaagactgggtacaggttgtctcaccagacttatctgcgcagggttatcaagctcctgatattccggtagttgcggggcaaacagtgatcattaatggtggtgatagaacgatgaatacaaatgtaattgtcaagtatcagcaacaaacgcatattgcaacgacgcagcgaacggttacccggacgattaactatatcgatggtggaacactgcaacccatcgcgtcactacatgctgttgttcaaacggttaagtatcaattattagctgtggttgctcatgacggaacgatacttggctacgataccaacggggacggacagattgagacacaattggcagatgaagcatggttgattgttggttcagggccgtggtttggcgcggttaagtcgccagatctgagccatgagggctacgcagcgccggacctaaaagtagtgccggagcagatggttgctggggtcgatgataaagatgttacgatcaatgtttattaccgactagcaactcaggccgttacggtgtatcaaaataaacggcgcgttatcagctatattgatcgacagacccatcaatcgattgccacgaccgtccagcaattggttatttaccaacgaacagcaattattgaaaaaaagactggcaaatgtttaggctatgatttaaacggtgatggattagttgatacgagtcaagctgattatgcgtggattttagttggcagtggtcaatttgccgcggtaacgtcaccaacgctagtcgtccaaggctatactgatccggacataaggactgtagcggctcaaacggtcgcgattactgatccggacctgatgacgacaatcgtgacttatgaccatcgtattattacggtaacaccaggcaatcctgctcgaccaggacagccagttgatcctgacaatccgaatatcttgtttccagatgagggtggcgacaccgatttaacgcacaccgttactagaatcattcactatgtttatgaggatggcacgacagccgcagcctcggtcctacaaaccgtccaatttcaacgcaatgcgatgattgatttagtgacgggcgaagtgacataccaagaatgggtaccagtctcggtaacggaaatggcgggcgttatttcaccaattgtagcgggtgccacgaccacattaacagaagtggcagcccagcaggtgagtgtcacaactgccgatcaggttgtagtggttacttacaagaaatcggcaatcaaaccggaagaaccgggtcaacctgagcaaccaagtcaaccagaagaaccggggcaccctgagcaaccaagtcaaccagaagaaccggggcaccctgagcaaccaagtcaaccagaagagccggggcaacacgagcaaccgagtcaaccggaagaaccgggtcaatccgaaaaaccaggggaactgcaaaaaccgagtcagccagctgattctgagcaaccagatggattaagtgatcaagccaatttgagtcgtaatcaggctgaacaatcacggacgtcacagccatcacaagcagagtcagatcaaagcgttgtgcagacgaatcagcagaaaacagctgcgtccgtttcaggtattggttgggttagtgcaccggcggtatcaaaacgtaccactaagcatcatcggatgacgacccttccccagacggacgagcagaatacgcaattatcactcttggggatgattggattagcattgagttcaattttaggttggctgaagattaagtcacgcgattaacagttgtgagatgatacccgttgtgagttgcggatctttaggaaccgggattgacggggttaacgttcctttgagggacagctagttttgaatgattaatataggcaatcactgacgtttcttattaaacggtagtgattgccttttgtgatatcgtcgttggtacttttgatgcggtcagttgaccggtcaaaatggcgactaataactgagcaaaggaacacacgcggcacttttcgtagtgacactaaatgtcagacatatgatagtagcaactgggtggggcgtttaaaaaattaagggttatgcctaaaaataacatttatcgttgacaattgtaaacgaagggattaatatacacatatagattacaagtgtaaacgataatgagaaagggacgaataaaatgatgattaaagtattagtcttattaattggtgggttagcaattgggtttattctgtggtggttcttcgggaagcatgctacgacaacggtcaccgcgagtgcagttgatgatctacagcaggttgatgtggaggttaagggtggctattcgccagaacaaatcgtgttgaaaaaaggggttccggcggtacttaattttacgcgcaaagatgcatctggttgtctggatcacgtggtgttcagtgatttcggtatcaatcaggaattgccacaaaatcaagttgaagcaattacgattgatacgagtaagtctggcgaatatcaatgggcctgtgggatggacatgtttcatgggaaattaatcattaaatagtgggaggaaaatcaaatgagcgcacgacaacaaatcaagattacagtagacggccattatgacccagcagaagtaacgttacaacaaggtgtaccggcccaattaacgtttacgcgcacgagtacgcaggggtgcttagagcaagtacattcaaccgacttgcactttacgactgagttaccccttgaccaaccgcaaacggtgacggtaccaactgatcaagccggtgaatttcactttagttgtgggatggacatggtgagtggcaaggtggtgattgcgtgatgagcacgacgaaacggttttggatttcattaatattttccctgccactactggctaatatgattttgatgccctttggctggatgctcccgggtggtgattggacgcagttgattctgacgaccatcattatggctgtttcggctcggccgttcttgcaaagtgcatgggcgtcctttactaagcaccatgccaatatggatactttggtggcgattggcactgcgacggcttatttttacagcttatacgcaatggcaacggggcaagcagtcttctttgaaagtgccgcacttgtgaccactttcgttttgctcggccaagtctttgaagaacgaatgcggcacaacgcgtccagcgcggtcgcaaagctagtgggcttacaagccaaggaagcggaagtgttacgcgatcaagaatttgtaaaagtgccgttggatcaagtagtggtcggcgacattattcgggtcaagccaggggaaaaaattcccgttgatggtgtaattacaactggccgctcaacggttgatgagtcaatggtgacgggagaaagtatgccggttcaaaaaacggtggcggacgctgtcattggttcaacgattaatagtaatgggacctttcagttcaaagctagcaaggtcggtgaccagacaatgctggctcaaatcgttgagctcgttaaaaaagcacaaaacagtcacgcaccgattcaaaagctgaccgataaagtttctgatatctttgtgccaattgtgctaattattgctatcgttaccttcttgacctggtatgttttcttgaatgctagcctcgcgaatgccttgatttttgcggtcgctgtggtcgtgattgcctgcccgtgtgcgctaggtttagctacaccgaccgcactaatggtcggtaccggccgtggtgccaagatggggatcctgattaaaaatggtgaggtcttggaagctgtcaatgacgttaaaacggtgatctttgataagacgggaacgattacggttggtcacccacaagtgaccgatgttatcggcgacgaagcccgagtactgcgcgttgccactagcttagaggcggcttcggaacatcctttagctgcggcaatattaaaacgtggcacggcccgtggtattcaagcaccaaccgccacgaacttccaagccatcgagggtaaaggtgtgactgctcaagttgagggccaattagcggtggtcggtaatcataaattattaactgatgagccgattagtgctgaattacaacgccaagccactgagcttcaggacgcggcgaaaacggtcgtgtacgtgggcttaaatcacgaaatcattggattgattgccattcaagacgtcgccaaatcgacgtctgaggcagccattgcgagtttgaaagcacgtggtttgaagacggtcatgttaaccggcgataacgaacgggtcgcacaagctgtggcggatcaagtcggtattgatgaagtgattgctgatgtgctgccaggtgataaggctgagcacgttcacgcgttccagaaggctggcaaggtggcctttgtcggcgatggtattaatgacgcccccgcgttgacgacggcggatgttgggattgccatgggttccggaactgatattgcaatcgatgctggtggcatcgtgcttgttaagaacgatctgcgtgatgttgaccgggcgttggcattgagtaagaagacgtttaaccgtattaaacttaatctgttctgggctttcgtgtacaacgtgctcggaattccagtcgcggcgggcctcttctttgccattggtctgacgcttagccccgaattggccggattagcaatggcctttagttcattgtccgtagtcacgagttcggtattgctaaataaagctaagatcagttcgaacgcccaacctgcgtagacgatgagcagatagcgtcggatgaaatcgggcttgttaaacaagcagaaatgtgtgttaatggtacaaaatatgcgggtgtctaacgccagttcacgttgttgggctggaggcgacacccgctttttgagtcgaaaatttaaggaagaaaactggctataaattcctcacaatcagtaaaaaagagtattagatttacactaattaagtatcatatcgttagtgtaaaattagaagaatgcccatttaacggagataagtgtggtgttagatgcttttgtaagcgcttgaatcaaattgtgtattgtgtaacaatattaattgtaagcggtttacatactatttgaaacgagggtttgaacatgaaaattaaagcagcagtggttgataaagtaaacgatccatttgtcattaaagatgatattgaattagctgaaatgaaagcaactgatttacaaatcaaaatggttgcgactggaatttgccattctgatgaagcaattcggcggggtgatgcgtcgttaggttatccagtaattttaggacacgaaggttctggaatcgtcgaaaaggtcggttcagaagtaactaattttgaagtgggcgaccatgttattctatcattttacgctgacggaacatgtgataactgtctgaaaggcatgccaactaaatgtcggaattatgccgactataacttgagtgggactcgtcccgatggttccgaccatttccaagaaaacgggcaccatatcagtgatatgttcgaccaatcttccttcacgactcatacggtagttgaccaacgtaatgcggttaaagtaccaaaagaactagatttacgtcgcttgggacctttgggctgtggctacgtcaccgggagtggcactgttttgaacagtttacagccgcgcccaggacaaacaattgcagtctttgggactggtgcggttggtttagcggcaatgatggctggtaagatttctggctgtaccgaagtgattgcggtcgacattgttgattcacggctagaactcgccaaagaattaggtgctactcatgccattaacagtaaggaagaagatccagttgaagcaatcaagaagttgacgcatggttacggggtcgactttgccgttgatacgactggggtagaaccagttatggtttctgcaatccacgcacttgctcaaggtgggacggctgctttgattgccgttacagccaaaaatatcaccattagctcatggaacgatttgtgtgttgatgataagaaagtcattggtgttaacatgggtgatgccatccctggtgttgatattccacggttaatcgatttctatcaacatggcatgttcccatttgaaaagaccgaaaagttctataagtttgaggatattaatcaagctaatgctgattcaggtagcggcaagaccatcaaacctgtcttgatcattgatgaagattatcaaccggggaaatagctgccggctgggtgccatcagtttatgatgaataacttctaaaacggcgatgtcaaaagttgattttgacatcgctgttttttgcgttaaacacaagccgcttggacggcttgcataatttgtgattaaaacgtgccggttcttaaattcaaaaacagccagctatggaccgctgggaaaaagttcgactcagcgtaaacttgtttagttagttcgtcctacaccgacttccaggcatttctgccaattgccggaacgtggtgggcacagatttaagccgaagcccacgtcttaaatactggcctttcactaaccaagccaaggacgcttgctaagtgaaatttcaccactgggcattggccgaaacgccttccagtcgggacagtgttcgaatggcggacatgtgcgtacccaacttttggcgaattcgtcattgtttttcataaaccataattttgtcaatcaactgtcagggtgaaaatgatattgagatagctcactaattctgaatttgtgtagtaagatttaagctcttgacagagggcttaatacacctaacgctttgtttaaagttccagtatcaaatagcgaacaacaaattgtaccgagttcggtggtcgttcattagccatttgagcggcttcccgaaacgtgttcggggccactaaagcctgtgcttgctacgccaacggactaatgccaaaaccgcattaatccgttggctaggcaatgctcggcttcaactcgtggcccctcacactcttgagaccggaggggctgggtgacaatgctcagtagccaaattattcttagtcggaagtggggtacttccggcttagaataagactcgtatttgagatgacgcgggttgggcgttagctcaaatcgacgtcggctacgttccagcaattgtcacccagccccggaggtcggaataggacgcgcaccggctgacgaacaggaatctacctaaccggcacgttttaatcacaaatcagaacaaattaatttgcacaatgcgtgttctgatagacattcttatctgtgcttgtcggtttattgttgcggtgtttattttgagtagcgcgtccaaacgtggggtgtatggcattgccgagtaacgattcaagttgtagagaggtcctaatcaaataatcggttcaagaatttactatgaattcttgaaccgattatttgctgtgaatgatttagttaactttgaatgggggattacttggcatcatatgcggcttggaaaatcttgatgatgtcttctttagtacctttgcgtgggttagagaaggcgttaccgtctttaagcgcattagtcgccatgtgttcgaagtcctcgatcttggcgccaatttccttgatggaatgcggaatgccaacgtcttcgctgagttgtttcatcgctttgatagctaattcggcagcatcacgagtcgataagccatcagtgttttcgcccataattttggcgagctcggcgaaacgttcggggcacgcgattagattatattcttcaacgtagggtaagagcagcgcgcagcagacaccgtggggtgcgtcatattggccgccgagctggtgggccatggcgtgcacgtaacctagattggcgttgttaaaggccatgccggctaacatttcagcttcgaccatgtgtgtccgggcttctaggttatgcccattggcgacggcttcgcgtaatgatgtttcgattaatttgatggcctggatgcactgtgaatcggtaatcggattgtgatcgacagaaacaaagggttcgatagcctggacaaaagcatccatgccagttgcggccgtgagtcccttaggaacatctagcatgagagtgggatcgttaaaggacacgagtggcatgttacgccatgaagcaacgacgaacttataatgcgtttcttcattcgtaatgacacagtgacgggtcaattcagaaccagtcccagcggtagtgttgaccgcaatcagtggtggtagggcattcttgagtgtttcgatccccgctaacttagtgatatcgtcgccgttagtcatgatgatgccggcaccttttccggtatcgtgggcagaaccaccgccaatagtaatcagggagtccgcttgattggcttgatataaggctttaacagcttgaatgttatgaattttagggttgggctcaacttgattataaattacgtagtcaatcccggcagcatccagtgaccgccgcacctgagcaacggcgccgtctggcagactttcaagaaatttgtcggtgacgatgactggcttgtgcataccaagagttttggcacgctcgccgattttactaatgacaccaggaccgaaaaagttaacgctaggcattaagaaatcaaaattacgttcagtcatattaataacctctttttatattgtaatcgctatcattactaatttacgaatcaaattatagtcgtaataattacaatttgcaatactttttggctaattaattatatttttcacaatatcgtttagaaaaggtgcggcaatcacggcatacctgttgtaaccaagtgttaaatgacggtgaactatagtcctcatgctatttgatattactgcctacaaaaagacgactaattacaaagattcacaatcttagtaattagtcgtctttttagtgtgatccaatagaaaaattgggttagtaccagtgatgatgttgccagaaccgtttggccttgacccaggaaccgtagcgcgaggcgacgtaggtattagcacgtttttcctgattgacgggtgacaagttgccgtgtaagtatgagcgcaacaattgatagcgaccgtagcagcggccattacgagccgtataactgtatccagattcacgataggcgatccaatttttggcagcgcggttagccttcgaaagcttggcgttgatcttagcaatttgctgggcttggctgagcttcttggaggcctgggcggtgattgcggtttgtggtccaagactagtagtcacgttaacgacgaccccgaaaacacaactagccaaaactaatagcaacatggttttaaagttaaattttttcatgatatgtataaccccgttttatattttccctaagctgataagtgtagaatacgccaattatgtgtcagctatgttaaagaaaagttactatgttattaaatgaacgtttccgttatgaaatagtttttgtcaataactgttgcggcaattgtttagatgaataattgcgctgactatcacatgaaaaaatcataatattgttaggaaaactaaagcgctttattgccttcgttcggtaatcttaaattggaatagctttacaaaagtattaaaggagtaagtgagggagtgcaataatggcaacaaaagataatgaaaagattacattgatggcgctagtcatgatgatctttacgaccgttttcggatttgccaatagtacggtggcctattatttaatgggttacagctcgattctattttacctagtcgcagccgtactgttcttcatcccgttcgcgctaatgatggcggagttcggggcagcggttaagtctgatagtagcgggatgtacaagtggctggaagtgagtgtgaatgcgaaatttgcgttcgtgggcacgttcatgtggtttgcgtcgtacattatttggttagtctcaacgtcagctaaagtctggattccgtttacgaccatcttctttgggagcgatcaaacgcagcgctttgcgatgtttggtctgaatgcgacgcagatgattgggattttgtcctgtctatggatggtgctagtgacgttcgtttccatcaaagggatgaaaggcattgtgcgggtcacgagtttaggcggcctggcggtgaccagtttgacggcaatcctgttagtggtttcgggggtcgttttagccttgaatcacggacaattcgcacaaccgttacaacatgtgatgacgtcaccaaatccaagttatcagcatccagtcgggttactcgggtttgccgttttcgccatttttgcttacggtgggctagaagttctcggtgggatggttgataagaccaagaaccccgaaaagaccttcccacgcggaattattatttctgccatcgttattaccttaggctatggtctgggaatcttctgctgggggattagtacgaactggcaagccgttttgtcgaatccaacgactaacctcggtaatattagttacgtcatgatgcaaaacttgggctatgttttagggcaagcgcttggtttgagtacagcggccgctaagacaatgggactgtggtttgcacggtacaccggcttagggatgttcctcgcttacagtggggccttcttcaccttaacttattcaccattgaagacgcttatcttgggaacacctaaggaactgtggccgaagaaatttacgaagctcaacaaagctggtatgccaagttatgccatgatggttcaatgtgccatcgtgattgtgatcattttggtggcgtcctttgcaacggcagacgcgtcagccttttacaatgtgttgaccttgatggcgaacgtttcgatgacgttaccatacctcttcttgctatacgcgtttccgaagtttaaggaaaaccagaacattgttaagccttttgaagtgtacaagtcattgacttggacgaaaattattagttgggtcgtgttcattgtcgtcttaggtgcgaatgttttcacgttgatccagccaatcttggaaactgggcagattcaaaatacgatttggatgctagttggaccaattgtcttcggtgtggccgggattatttggtatcaagttcgagaacggcatgtcaattaaataaccaatttcaaaataccattcgattgctgactgataaaacagcattgaatggtattttttaagtgccttaatatgggaaatttagtacactcattagcaaaagctatctaggggggaatggtcatgacattgggaactgcgttaaagcaggcacgcaaagcccagcaactcaatcaaaagcaagctgcccggggaatttgtgcacaatcgatgctgtcagcaattgaaaatgatcgctacgtgccgaatgcccggctattactggcgctgtgtcagcgattaggggtcgcggttagtacgttgagcctagccgacgattttgagatcagtgccgagcaagcgtttaatgaccgcgttcggcagatgtgcaatgcccatcagtatcagcaattgaaggattggctattacagccaaccactttggaacatgttcaaacggatgagcagactcaggcttactattattatctgggtgtcgcctgttggcaggttgatcgcacatcggatgctgcacaacaaaatttacggctggcaattggtatggctgctcccagctcgccgccgacaacgttgacacgcttggccttgatttcgttagccgtcgttaaggcgcaccaccatcctcaagccccagtcgcggccttagtcacccgggcactcgctgacattgatgcgggtgcatatgaagaaaatgccaacattgttttttaccttgctgggttggtggcttatgaacaacatgattcccagttggcggtggcccgtttgacgcaggggttggcctttgcgactacacacgattcacactacatgctggctaatatttatcagttgatggcgcaactcgcaatggcggcgggggagactgccacggcgcaggttgccagtcaacggtcacaagttttcaaagacctgtttaaagaacaaattaacgaccgcctgtaaattatcagtattctgattttatgttggcgtccccaccgtgtattttataatcaccaactaaatacatgtgcacttgatctaacggtccgttattgatttggagtggttggccgtaataacgatgaccgggtcaggatgaacattgggggttataaaatgacaacagcattatttaccaatcaagtattaacacaggcaactccagcaacggtgcgagcattgctagcagatccgctgaacttaccagcatgggcgactgccattaccacggtcaagccaaccgcgacggggtacgtgttacagcggtccggttcggtttttgatcagccggaacagttgcaggttacagtcggcgctgaccaggtcgtttatcacagtgaggggggccaattgggatatgaaattgtgttcaccatgacgccattggccgagcgaactgcggtccaggaagaagtctcccttacgactacaccgccgagctggctaccattgccactagtgaagcccgtcatgcaacgagactttcagcggaagttgggtcaattggcaacattagcggaggaacagccgaatgacgattaatgatgggatgacgttaataaaagtgttagtgacgtggtggtctgtcagttggttattacgggccactttggtcggcgttgttggaataattgcctatcattttttgaagcaacgttaatttaagtgagttaagacgatgacagcttttatgcctaatatctaatcgtaactattattatttagtgtgcgtttaactatcatccgcaaattaattccggtattctatgggtattcttttgaaggaggaaatctcatgaatcaaccagaattacgtgacccacgctatttatataagacagatggctttgataagcaggatcaggagacgcccgcactacaagctaagatgcgtcctgaacccgattgtggtgagaagagttaccaaggacatgataagttgttgaatcgacgcgttttgatcacgggtggtgattcgggaattggccgggctaccgcgattgcttttgcacgggaaggcgctgatgttgcgattcagtacttgccgggagaggagccggatgctgaggcggttgccgaactagtgcgtgctgcgggccgtcaagcgttattattaccttgtgatttcaaggatgttgacgttgtgaccgacctcgtggaccggacaatcgctgaatttggtggtatcgacacccttgtcctaaatgcggggcaacagatttcacaaccttcactggctaagctgccgatcgaacaggtgcgtgcgaccttcgaagtgaatatcgtcgcgatgtttgcgttggctcaggcggccttgccaaagatgcccgctggcggtagcatcgtcaccacgacttcgattcaagcctatgcgccgagtggtcatctattagattatgctgcgactaaggcggccatcaagaactttacgattaatttagcagccgaagcggccgaaaaggggattcgggtcaatggcgttgctcccgggccaatctggacgcccttacaactagatcaaggccagccaatcgaggcgctgccgaaatttggccaagacaccttgctcaaacgagcgggacaacccgcagaactggcaccagtgtacgtctttttagcttctaacgacgcgagctatgtgaccgcgcaaatttatggcgtgactggtggcggcgtgattaattaggtgttcactgcaagttaattcctgattggcttgaataaatcataagtggctaccttggatggatacattcaaggtagccactttagtgtgtttaatgatctgatgaggcgttcattaagtaatccagcgctgccgttcccgccgctttggccgcaattagtaaacagtcttcattcatcataaaatcagggctgtggtgcgggtgggtctcacccggagctgtttgacagccggcatagataaaggtgctgggtttggcttgtgcaaaataggcgaagtcctccgaggggtcttgggggccacagtcgaaaattttagtgatttctggaatctgagcggcttgaatactagtgatgacgcgctgtgtcagggttgcatcattcatgagtactggataattatcatcgtaatcaagtgcaacttggacaccgaaagtcgccccgacgccgttcgcaattttagtaatctggtcacggatggtctggcgcgtggtttcgtccataatccggacatcgcccttgagggtgacttgcgctttgatcgcattgaaggaaccgacgccgtcgaatgagccgatggtgacactgccggtatcaaatgggtcaatccggcgggaaataacggtttgtaaggcggttacaaagtaacttccagcaacgattgcatcgtttgagaggtggggcatcgaggcgtgcccacccttacccgtgaaggtgaccgtaaaattagaccgcccggtctgcgtcgcatttaagtgataggcaatcgagcccgtcggcatggtactcatcacatgcagcccaatgacgttatcgatgccgtctaggacaccagcagccaacatacccttagcaccacccggtgacacttcttcagcgggttggtggataatgcggacgcgaccacgtagctgatttttcagcccgagtaaggtcttcgccagtaccatgagataagcagtatgaccatcgtgaccacaggcgtgcatgacattggcgttttgcgatttaaatgataagtggttgtcttcttgaatcgcgagggcgtcaaaatcagcgcgtaatgctaattgaggtccaggttgaccgctatcgatgtcgacgacgaagccgtacccatcaccataagcggtggttgagacgcccagttcacgatagaacgctttgatgtaagctgcagtttgttcttcatgaaatgaaatctcggggtgggcgtgtaagtggcgacgaatcttgatcatttccggttccgccgccgtgagttgttgcatgagttgtgcttgaagggtcattagaatcttcctttctgatgctagaagcgagtatattataaatatagctgagagatgatagtactgcactaatctttagcttagcatgaaatggcggttaataggtatcaatgtaactatggaattttcggacgcttttttaagtagtggataataactaaaaggaatattctgcattgctcatgtcctagtaagatattagatagccgctccaagaatcgtgtctgcaattcttggagcggctattttttagtcgattcaaacatatagtgtttcttaataacaacgttgaaggcgcttttgtgaaagcttagaagttcgtcacctgtttgatattaacctttaaaggtggtaattgaactgcctgactggtttttttattcgtaactctctgcgtgacagttaagccacgggtgctatttttgatttttgcatttggaataaatacttttgtagtcgcacttgcgttcttgatggttttaattacttgaccgttttgtgcaatattgatggttgcatctcgagaaccgataagcgtgtaatagatacctttggttgttcgcttggcactagtgactttaacctttggggttgcgtattgttgggacggaattgtggctagcacctgttgccctttcattaatttgaaatctccgtagcccttaaactgctgtgcaaacttgaattgtcctgatttgacgttgacggttcgaacttttttgccttgataagttagcgtgaggtgttcgattccaatcgcgcgaccctttagtatcaaggagtgtgattgtgaactgtaattagttgtgatatttgtaatcttaggttgtacatgaagatattcggttacagtgatgatttctccgggattatttggaacactatcaaaagtggtagtcgtggcataacgagccttcataccattaatatcgcaggcttgaatagtatagtaccggtttgctggattcattacagatacactatcagtattattgtgcccaattcccagagcatgacctaattcatgctctgcaacattggtacgttctgctttggtataattatatttttcaaataccgctcggttgatgcgaactttgcttgaagtgatttcgccagtagatttattataggaaactgaattgtagccggccagagtcatgtcagaacttccatcatacgaagaaacggtggtttttgctgtagctgctttcgtccacgtaaaaccagcctttttccaagaagcagttgcgttgttccatacatctttatagtagtcggaggatgataaatcttgatagtttgccgcttgtttatcatatcgataacctaacatcggagtggtagcttttgttgatgcgttggcacttagaagtccaaaactagttgtcaaggaaatcgtcgcaagtgttgaaaagattctttttggaaagcgcattgtaagttcccccttttaacgatatttcttatagatgaaatgaattgaacggcgggcaaatatttgcaatattaaacgacaggtagtatcaattttttctcgagatgaaaattgatgtttataaatacagaaggcataatgcgatttgtatttatttagtacaagtattatatcatcttggatgttccgtgaaaaaaatactgtatagtaaataacttatactaatttttaagcgctttatataaatcaatttgtatctttacataatttatcagagcggtggaaagatattgctcccacacatactgaattattatcatcgtaatctgtttttgcaaaagatatgatatattgattgtcctgactgttaatttcaggtaccctaaacagggagaccacaattatgaggaggaacgattgatgaagattttgatgccatattttaagcggtatcgactagacgtctggattgcgatgttgtcggtcatcgtcttagtgtttgcgacgttatggcaaccgcgattattgcaagtcattatggaagctattatcaagaatgatcaggctacggtattccgtgaaggactgatgttgcttggcttggccgtactggggatcattggtgggatcgtgaatacgatatacgcagcccgggtggcccttggtgtggcgaccgacttgcgagctgacctatacgctaaggtccagtcattagcctacgctgacgtggaaaaattttcaccgtccaacttagtggtacgaatgacgaacgatattaatcaagtccaacagattgtgatggctggctttcagcagattacccggattccattactattcatcggggcactgattctcgctgtgatgacgatgcctgagcagtggtgggtcattgttgtcatgatggcggtaatcttaggggtcgcactgattgcggtgcggcgaatgactaaatactttgcacaaacgcaacaagatattgaaaacgtcaatacggttgcccgcgaaaacttaatggggattcgggttgttaaatcgtttgttcaagaaccaaacgagatcaaaaagttttcggccgcatccgatgaattaaccgctgtgaccgctaaaattgggtactggttcgctattctaatgccagcgttctttttgacggccaacgtggcggtcggggtcgccgtttacttggtcggtcaaacgattacgacgcacccggcctatttagcagctattacgagttttatttcttatttaatgcagattttatttgccgtgatcaacgggggctttctcatgacttttgcgtcgcgggccgtcatctcacttggtcgaatcggcgaagtgatgactaccgaaccaagtatgacctacgttgatggcgacgcagcgcccgtagctggtgatattcactttgaccacgtaaccttcacttatccgggagatgcgcagccaacgctaaaagatgtgacctttacggtaaaagcagggtccatgctgggaatcgttggggccactggatctggtaagacgacgttggcccagctgattgcgcgcttgtatgatccggatagtggaacggtctccatcggtggaattgatgtgcgggccttaccagaaaaagcccttcgatccacggtggcctatgtcttacaacggtccacgctattttctggcacgattgcgggtaacttacggcaagttaagccggacgcccagcctagtcacatgcaatgggcggctaatattgcgcagtctgcggaattcattgaacggttgccacagacgtacgatgcccccgtggaagaacggtcacagaacttttcgggtggtcaaaagcagcgactagcgattacgcgtggcgtaattgccaatccagaaatcttgattttagatgatgcgacttcggcactcgatgcgcgttcagaaaaacttgttcaagaagctttggatcgcgagttgaagtcaacgacgaccgtggtcattgccgaaaaaattgcttcaattattcgtgcggatcaaatcttagtgttagataatggtcgcatttcgggccaggggactcaccacgaattgcttcaagatagtgcgatttatcgcgctatttatcaaacgcaaaaagcacgggaggagggcttacatgagtgatttacgcaatgctggtaaatattactggcactatttaaaacgctactggttaggcttcttactaagtgtgattctgattgccttttcgacttggtgcattgtggtcgcaccgacttatctgggacgagccgtggaggagctgacgcagtacttgcagcagtggacgaatcaagcgactcgggaacaagcaagcttgcaaccgttcaaccggaccctgatcatctacgtcttgttgtatgtcggtgatgctagcacgatttttattgcgagcttgatcttagcacgcgtgacggccttttcgaccgggacaatgcgggtaggcctatttcggaagatgcaacggatgaaggttcaatactttgatacgcatagtgacggggatattctggctcggttcacctctgacctagataatatttttaatgccatgaatcaagccttgctagaaattttattagccgtggctcagtttgttggcctgctaattgtgatgtttaatcaaaacactacgatggcgtgggtgacgatggcttctacgccggttgcattaattatcgcggcgtttgtcatgcacaaggctggcgtcgcggtgaaccaacaacaggatgatatcggtcaactgaatggttatatcaatgaacaaattaccggtcaaaaagtcttgattaccaacggcttacagcaggactccttgaaaggctttcatcagtataatggtaaggttcgccagtcagcgttgacgggtcaaatctggtcaggtattttgaatccactgatgcaagggatgtcactgcttaacacggcaattgtcatcttctttggctcatggttagcgctgaatgggagtatgtcgactggagcagctttggcgctggtcgtggtgttcgttaactacgcccaacagtactaccagccaattatgtcattgactagtttatatagtatgattcagttagcgattactggtgcacggcgggtcgatgaagtccgtaatcaaccggatgaagtgagccccgctaacggtcaagcgctcgacgggattcatgatgaattactgattgataatgtgcgttttagttacttaccaggtaaagaaatcttgcatggcgtgtcgatccatgtgcaccgcggtgagatggtggcactcgttggcccaactggttcggggaaaacgacggtcatgaatttgttgaatcgcttctatgatgttgatagtggtgcgattacgtttgatggggtgaatattcaagactttgatctccaggtgctacggcaaaatgtcgggattgtcttacaggaaccccagttgtttacgggcacgattgcggataatattcgttacggggacccaacggctagtatggatcgggtcatcgatgcggcgaagcaggctaatattcatgactttgtgatgagcctgccagatggctatcagacgcgcgtttccgacgaacagagtattttttctgccggtcaaaagcagttgatgtcaattgcccggacgattttaacaaatcccaagttgctgattttggatgaagcgacttcgaacgttgatacggtgacggaagccaatattcaagccgcaatggacaacgtcatccaagggcgaaccagctttgtcattgctcaccgcttgaaaacaatcctgaatgccgataaaatcgttgtattgaaggatggtcaaattattgaacaggggaaccaccatgatttattagcggcaaacggcttctatgcggaactgtatcgtaatcagatggtctttgagtaatgaaagtataaggagtcggacatggcagggcaagagcaacaagtgcgggtttcaatcccagtctcagcattaaaacgagccgggattgatcgcgatgatcagttacagttaaaggtgcgcaatgacgcactagtcttagagaagattaagccacgtcaaccacagtggcagcaatacttgataatctggccgctgttggttgcaatcctatcggggttagccagttacgggtactggtggtttcaaaaagtgcgaccagttccactgacaggtgcgcaatcaatcgggagtttgacgattgtggccggtgtggttaccggcgcagtgctatttgtcggctttttcttaaaaacgcgtaatgatccagaaaatcgattttcgcgccatatttattggcggaactttccagttattacgattgcgtttattatgatcttagcctttgcgctggtcggggctttctgggtattagaattattatttccagatgtcatcttcgatcgctttacatctatgttgctactggtcttgtttacgtattttgcggatgcgttcatgattagcgctgcgttgacgataaatgcgcggtcgttatcaacgattttaacggtggtgattgtcagtggctgtgttatctcaatggccgccaatggtcaacggcgatggtggcagcataatttaagctttttagggacgcatgccgctgaaaatgcctggcaattcaacttgacactgattttttcggcgttattgatggtcgttctgattgactatctatttgtctcacttagtcgaatttatccgcgtacttggcgaacgtcaaccttgcggatattgttgacgttgaccgctgtcgatttcggggcggtcgggctatttcctaacaacctgacgtttcactggttacatgacttagttgctggtggcttggtcacgttgttagtcttgttgattgtgggggtgcggtggctattaccagctgtgacgaaagattttctgtggctctcatacggcgttggcgtggtgctattactactcaactttggttttcgctggtttgggtatccatcgctgacggcatttgagattcaagcctttgcgatttcgtttggctggttgctgatgctattttcacgtctacaagcgttagtcaatgaagacccggaatttttgacgattaagttggagcaggaaagtacggcaggacaataagtgccacgttgttttgaaacggtggctgagtatattaataatagttgaatcagataaaactggctgctagacacggtttaaagtgtctagcagccagttttattaattatggatgattgttgaagcgggttaggtgtaattgattacttttaaatgttcacatttagcgatgctgagccatcaatttgacttgtggcaacatgttatcagtgcccggttgagcaataccaaggctggtattttcgtatgctgttggctcagcaataatcttcatgattaaatcagcaatactagcgcgtgaaatcatggttcctttgaagcgttcacctttgtaagtcagttcatagtcaattttggtatcgtcggtcatataggccgcacgaataattgtagcaggaatatccgatgattcaattattctggccgcatgtcgcgtatcgtttttagcagcgtgaccgactacctgttcgacccaagcgccaaatggattaggggtttcgtggtagagtccggatcctgtgacccaaataagatggggcacatgattgcgattcattgacgtgataatggtctgtgccaataatgccatattcccggctagatttgcatagacgatatcctgattaggcataacagtgtctagtagctgtgaatcactgacatcaccttgaataaccgtttctcgttctggtgaagtgactagtaggcgccctgcatttcttaagactagtgtcaactggacgtcagtttcggctaagagtcgttgttccacaatccgcgcaattcgaccgttagcccctaaaattaaaaccttggtcattctgatcctcctcgtattagtgaatagtgtaaccaccgtcaacagcgacggcttgaccaaccatataactggcagcatcactgcaaagaaagagtacgacttgagcgacttcttctggtttagctaaacgccccatgggaatttcgcggactaggtcgtccatctcctgtcgttcagtatcatccattcgggcaaccattggtgtatcaatgattcctggacacacggcgttgatccgaacattccggtcagcgtattctaaggcgctactctttgtcaggcctaagacgccgtgctttgaagcatggtaggcagttcgatcagcaataccaacgagaccacccattgaagaacagtttacgattgcggctggtgttccctgagcacgcatctgtcgtaattcgtacttcatactgagaaacatgccttttaagttagtatccatgacatgatcatattcttcaaccgatagatcggcggtatcggtgactggactttgaatcccagcatcgttataagcatagtcgaggtgcccaaactgagcaactgcgaatttcaccattccggcgacgtttttgggatcagcgacgttacacttgaatgaaacggctgagtagccatgatcgactagctgttgggcttcgtctttaggttcatgatggccagctaaaatgacgtgagcacctgctttggcgaatagagtggcagcactcaggccgattcccgtgcgtgcacctgtaacaataacgactttatctgtaaaattgaacatgactttctctccttaatcaatcttcttcaaactgcattttaatatttcttgatgaacggaattgtttcaaatcgccagcattaatgtgaccaattttttgaaggttactaatcacttcgccagtttgctcataaaaaatcactaagctgtgtcgcggtgtccagtaggcgatatcaccaactgcatagccagtagtgtatgcctcgttagcagggagtgcctgctgaaaacgatacgtcaattcacggttataaaggttgagcatcggcagtgttagtggtagttgtgaaagtaacgctgcggtggtggcattttcttccaaatttgctgtgaagtggcggtcgttggctgttatcttcattttcttcattatctagtacctcctaagccaatgcgttatattcgtcattactaacgggtgatagccattctggtgtgcctgcagtgatggcaatgtgactgaaccaactatctttagtagcaccgtgccagtgtttgataccgtcatgggtgatcaccacatcaccaggatgtaatcgctgtgccggttgcccggcttcttggtaccagccttcgccaccagtgactaataagatttgatagccattgtgatggatatgccagttgttacgggctccgggttcaaagctgacgttgctgacagttacgttgacttgctcgtctttcactagagcgttgtggtaacttttaccggtaaagtattgttgaaaagcaacgtttaaatctcccattgcaaaaatgccgtgttggacgctattttcattattgttcattgttaaaaacacctttcatttaaaattaattgtgggctaaaatttgaagctcggcttttgttagtacgtttcccactagttgttcacggaagtcgttgtagtagaagcggttattcaacggcaagttgtgcttgagtgcaaatacggatagtgtatatcgatgaggctgatcaggtggatttggtccggcatagtgatcggcgaaatacgaatcgtttaactgataaaagcgtgacatccatgagttttgaccttgggggccctcaaaattacgactgaaatcggctgggatttctgccatgacaggaatattggtcgcgagccagtgaatgaacggaaaacccgttcgtgggacggcgtcgtaatcaatgagcgaaatagcaaacgcagtcgttattgcaggaattgatttgatttcaattggaaacgatagaatcggttggcctgagtgtttgacgttcgcgttactggtatagattcgtggtaaaaagccatcgtctaaatcaactttaatttgcattaaaccgacctcctagtaaaaaccaggtttgttccaagcagtattgggttcagcgacgccaatgctacttcgctgatataattggggattgtgaataatttcagtaatcaggtcagcaacggcctggcgtgtcacctgcgtatctttgaatggcatcccttgaggaatgaccttgtagtccgtatgctggtcattattatatagccaggccattcttaaaaatgtatagtttagtccactattatcaatcacggcagcagctcgcttgatttcagtataatcacccatcatttgggcattccaaataccaaatttaccagcgacttcatcgtaaatgcctaaaccacctgcgacaattaggcgctcgacaccattttgcttcatcgcatcgacaacattttgattggcggtggtgaaatgccccgttgccaagtaaacgatatcttgacccgcgattgccgccgtaagatcagcggaattattccaattgccgttcgtgagagtaacctgcgattgggcggcgtactgatgaagccgtcgagtagcttgacgagcaaatagtgtgagttcaacatcgttttttgcaagtaggcgtggaattaaatattttgaaatgttactggtagcacctaataaaataacttttttcattgtaagaacctctcttttaaaaaataagacttaataaagttgctacgcccaaactaagtacgaggaagatgaggcaaaattgccaattccaacgtaccgagacagttgctgagctgacatgtaacagggtcgcgacaatcatgacgatacctgcaaacggtgataacatgtatgcaacgacgcttccgatattcaggctcaatgcgattaatagtggtgaaagggcaatgtgcatggtcataataatcttgccaattagtgctactgatgctagtgggtgaatgccaattagggaaaccaatacgacaataatgggaattaaaacgaccaataaccagccaaggtgagcaaagcttggtgctaacgcgtgggttagttcgctactgatagtggaatgttgaaaaccgtacgtgaacgtgccgattccaacaaagaacggcgcaagcgctgcaccgcttgcaattccgtgttgccaataatcaaggctagctttttttagtgcaaatttgaaggctgtttggcccgtagtcggcttgagccctaatgccgtgacccaaatcaggacaattagtaaaccggaaagtgtaacagcgttcattgaacttacgactttgctttccattaaaacaaagctgagtattagtagggcaataacggccgccactaaactgacaagtgatgcgtgttcggtaaaacgagtctgctgcttagtattggttgtcacgggctgaattcgcatatacggttggttatgttccatcaaatacgctagcaataatcctaacaggcctaaaatcaggcatggtatgaataattgggtccacccgactttagtaacggtactgattagaaagattgttgctgctccaggtgcccataatgtgccgagcgtaaatccacgggttacggctgttgccgaaaaacgggtggcgtctttgacttggcgcttgatactgtcgcctagaattgataggacaatggcaacggtccccatggagagaatacttgatagtaggtgcgtgacaatcatgacaaaggtgaaggtttgtttggggccacgaatgtgcttttgcatgaatgcttcgacagtagcttggtagttgccaatggtgacagggattaagaaaagttgcataacaactagtaacaccacgatatcggccattgaagtgattgccatggctagaccgttgattgataaacccgtagtacttagcagtcccaacccagcaatgaaaaagatcaatgtcgcgacttgaaaagagcggcttaagctttgaattccgagaattgagaccccgattgcaagcacggcatttaatagtgtcaagttgacggggacaattaagcttagtaactgaatgattattaggcttaaaactagactgtgataaatcgtcgctttattgatagaccgttccattcatgaatcgcttctttctaatattgatcgtggattgtcgtcatcgattagccttgctttgtcgggtaaatggtaaattcattgacgttgacgtcatctggttgtgcaactgcgaagtcaacgacacgggccactgcatctggggtgataccgacggatgcatataatttattcataccttgcttagcattggtatcggtaatggtgtgcaataattcagtgttgatagctgccggatagaggctggtggtccgaatattggtgtgttcttgagcactttccatgcggattacttccattaagttgcgtactgcaaatttagttgcaccatagatgccggaaccagcgaaactcttaagcccagctactgaagatgtcgtaatgatttgaccatacttttgattggtgaaatcaggcattactgcggcgacaccgttcaaaataccttttaagttcacatcgatcatggcattccattcatcagtttttagtgcactgattggtgaagtcggcatgataccggcattattgaaaatgacatcaataccgccaaattctcgcttggctaaagcaactaacgctgttaagtcttcaggcttagtcacgtccgttacgcggtaagtggcttgcccaccttgttgctggattttattggctaatttctgtaggcgttgttcacgccgtgcacctaaaacaactttggcaccatggctggctaacaatttggcactggcttcgccaatacccgatgaggctcctgtaataacgataactttgttttttactgacatatttgtttcctcctgattaatttttttgtttatttaaaatgtgatggtaatttaagacgtccattgtggaaaaatcatgaccggaaagctggattttttcaccatagggtgatagtgaaatttgattgtgcccaataattttccaagtaccggaataaatattagtgacgtgatgttggttctccttccacttgtgatccgcagtgaaagtgatttgttggtgaatatctttgttgtggtgattgatccaaacaccaacgacatccgcttcggtcagatgcgagttgtccgaatgggtaacacttgtctgttgcttggtggcttggttagacttgtcggtggttggtgagtgttgctgaactgcatagacgatgacgacaagtgcagcgacggtaacaataatttgaaaaatagtttgcataaactttttgttcaattaatcatctcgtttctgatgtgctgtgcctcaactacaatgactagtatagccagcaacgtgcctcctgagaagaatccgttagttagcttagtattaacttttagtttatactagaaggctaggaggtgaccgttgtggattttaatcaattacagacgtttttacgagttagtgagtatggtagttttacgaaggcgggggaacagagttttatatcgggtactgcggtgatgaaacagatcaaccggctggaagcggagcttaacctaaaactattcgtccgaactgcgaccggggtccaactcacaccacagggtaagaagttccaaccgtatgtgcaacagttgctcgatttactaaacacggccattgaagagacgcgacgggtccgttcagacgataagcaactgattttgttgggaacttccttactacatcctgctgatgccttcatgtcattatggaaagaactggcaccaaagatgcctaaatttcagattagattagttcaattgcaggaagacttgaattcgagaaatcgtgagtatgcgatgcttggtcggagtagtgatttaatcgttgggacgttcgatagcacaactttgaagcagtcctttagtgcgataaagttgggagcgtatcactttggaattgctgtccgtagtgataatccattagcccagttggatgaaatcacgtacagtgaccttgcgcatcgtaaagttctgatggtgtcaacgggaattagtgagaaaaatgatctggttcggagtgaaatgttggcggcagaacctagtattcagccaattgatactagcgggcgttatgacatcaatacgtttaatgagaccgttgaggagaatatcgcaatgatttcgcttacgccgtggaaaagaattcatccgaatttagttacagtaccgctgaaaacgtccgtgacagtaccgtatggcctattaagcaccaagttcccgggtaagaagacggcagattttctacatgaatttacgaagttggtcccgactgaaacgcagagccactcataaaatgacattaaaaaggcaactgttcgtggtcacggtacgtgctggtgaacgggtgccttttcggggcttaagtctaatttgaaacttgcaattatttgttaacggatactggtattcaacctgattttaatttataattagttaaaagaacatatgttcttttaacgacaagttattgaatcaggtttcatccaaaagtgagtgtcatgggggcgagcgacatgcggctatcgttaagattcgagtatcagcatgaggtttattttggattaccagcaaaatgttaaggtgaacaacgactgcgattgtgccgattaattggaagggagtcattatattgatggaacagcgaacatacatggcaattgatttaaaatcattctatgcctcagtcgaatgcgttgctcatcaactcgacccattgaatgccaatttggttgtcgctgatacgagtcgcactgataagacgatttgtttggcggtttcgccagcactaaagcaatttggtgttccagggcgaccccggttatttcaagttgaacaacgggtcgcaactttaaatcgcgcccgtggtcgtcagacttcctatcaggcggttcggcggcatcgctcaatttatcgtgatcagctcctcaagcatgctaatttgggtatcgattatcgggtcgttcccccacgaatgagttattacatgcagaagagtgctgcgatttatgatatctatttgcgcttcattaagccagaacacattcacgtgtactcgattgatgaagtcttcatggacgtcacagactacttaagtacttttcaggtttcaccgcacgcactggcaaagacgatgattcacgagattcaggccgagactgggattacggcgacggctgggattggtgctaatctttacttagctaaggtggcgatggatattgttgccaagaagattcccgctgacgctgacggtgttcggattgcacagatggatgagcagcaatatcggcaatacttatgggcgcacgagccgttgactgatttttggcgagtcggtcatggctatgctaagcggttggcagccctggggctcaatacgatgggtgacattgcgcgctgttcactaggaaccttgtcggattctcataatgaagaacaattatatcgtgagtttggtaaaaacgcggaactgttaattgatcatgcgtggggcgatgagtcggcaacaattgctgacatcaaaaattaccatgctagcgaacatggtatatatgccagtcaagtgttgatgcgaccgtatacttatactgaagggcaggccgtgttacgcggcatggtgaataatttgacactcgaactggttgctcgccacgtggtgacagatcagttgggaattcgtattgattacgatgctaatgcttcgtcagttggcacgcattatcagggtgcggtcaccgaagactactatgggcgacaagtaccaaagcccgcccataccacggtgacattagcgcaggcgagtgcttcacaacacgagctaggggctgcgtatcaacagctttatcaacaagtcgttaatcgtcaattgatggttcgacgtgtgaccgttatggcgaaccatttggtcgacgaacagcaggttaggcgccaacctcggtatcaacaaactaacttatttgaaaatccagaagtggcccaagcgcaagaacgagacgcacaacgcaaacgtgaacgcgatgggcaattgcaacgcgccattttgaaattacaacgtcgttccgggaataagaatgtcgtcattcgcttggcagatctaaaaccgagttcaactacgattgaacgtaatgagcagattgggggacatcgtgcctaatgacaaaggaagccagtactactgcgttatttaatgatacgagtcgctatgcggatattttagagtgctcgcgacctacttcaaggcatttaccaatgccccaagcagaccgtgctgcccaatttgcgccgttcgcggcgttgactggttatcatgacttgattgaaaaacacgctgcaatctatgcccataaacactatccaaatgctcaggataaaagagctgtggcgacccagttgaaacagattgcagcgttaccaaaactaccattgctcaacgtcgattattttaacgataccgttggctattatcagacggcaaccagccagttggtgaagctcgattggcatcaagcccggatttatctaacggcaccagcaagtattgcgatggccaatatccgtagcgtttctatagcgaattgatcttaattaaggacggttccaatgactaaaattagtcgttagaaccgtccttttaagattaatgattattttatttcgcggtgatttgcattcgtccgtgctttttagaatgatatagattggcgtcgacgcgctgataaaaggccgttggtgattggtcatcagttgctaattctgataggccaatcgagatcgacagttggatttgatgatcattaactggtacagcgatatgattgatggccgcaaatagttgttcagcgaccgcaagtgcttcggttaaatcatagttggggaagataacgttaaattcctcgccaccggttcgatatagtgagatttgcggattattagcatgaaagacaatcgtagctacttgggcgacgtgctgaagaattttgtcgccagccaagtgaccataagtgtcgttgacttgtttgaagtggtcgatgtcaaacatcagcatggtcaattgtgagccgtttttccgactgcttgtaacctgataattaatggctgttttgtaagctgcaaaattttcgattttggtcagagcgtcgtgattagcgaatgcgaccagattctgtttgaggtgtgcattggctgacaacatgctggcgtagatatagagcaaggaagcaaagacgagtaggtaggtccattcttgccaataagttgcccatgataagttgaacttaagcttcatgaaccaccagagaacggccccaaaaccagcacaagtgactaaataaagtgcgacttgtccctgtttcgtttggagtgggacgtgtttacgcaatcggccgagcgccgtaaagaagaggatcagtgtgacggcgtgcccccacgactcccagtaatacaaggagtgattgaagcccataaagataaagacaagcgggtacaagtagtaatagcggacacgtacattgagaaagtagccacaaaaggttagcccgatgagctggaaattcatgaaaatccaggcgtcgttctggcccacaacggcagtttgcatcccaaagacaaataacatcatgtagattaagccgtaccagtcggtaataagcgattggtcaacccgccaatgatgagtattgaagaagttgataatccaattttgtgatacccaaaaaagggtcagcacgcctaggatgaaaaaaacacttgtaataaatggagttatctcccaatgtgaccaagtcatacgcaaacacctttcaaatcgcaaaaactgcgttggttcgaattaaatgacgccggtataagtatatccctttaactgctaaatagcgactgtgattatggactttaattggctttttagccgttattatcagggaaaatcagcgggcctcgcgctagatacgccgaacggcaattaaagcagcgcaacaagcctgggttaaggcttaaaatgcccgagttggtgcggtgagcgtgggggcagcatcgttgacgaaggccggggagtcgtcgtaataatgcccagttggtcgggacgtgccgtaataaaaccggtgtttaccaaccaagcattaatcgttatcggaccgacaaatttaaaaccaacttgttgtaagtgctgtgcgatgcgatcgccagtaattgttgtgcgtgggagttcatcataatactggggctggataattaattgttgatggcccaattgttgccagagatagtctttaaaagactgtgtggtccgaatttgttgaatcaggcgagcgttgtgaatcacggcttcgattttacgacggtttcgtatgatggccgaattgctgaggagaccggtgatttgttctgggcgatacgctgccaccacctcaatttgccaggcgtcaaatgctgcgctgaatgctgagcgtttattgaacacgacggcccagttgagaccagcggcaaaaccgccaagactcagaaactcaaataattgttcatcgcgctgaaccgggataccccattcgtgttcaaagtaataccggtagccggtatcgtacggatagtaacgattgaatagtggatcatcatcaaaccagttggtaatcattaaacaagcctcatttccaaatcaattattagacactaactaaatacggtaaatgggtcggaaaacacgtggataaaaaaacttttccaatcttcctgagaatggaaaagttaacttaaagcgtgttcaacgatgatctttgattacaaggttagttggcatgtggcgaacggttttcgtcgcgtggtcacgcttgatctgagctagaatggtcctcatactgactgtggcagtcagatcttttttaaaagtatgaataccaaagctgtcataagtgacatggtcatttttgagtgtgaaccagttcggctggagttgcttggcatctgccttaatgtgtttatcagaccaaaccagatacttagtttgcccctggtcagtgtaaatttcgacctgccaacccaagctgaaatcactaacttcttgccaacgctgaatctttaagtgcttgattgcgtaataaataatgcagctgtattttgaagcaggctgtttagcaatggtcgtttcggtaatcggttgtggttgttggataacgcgtgatttgtgaaccgtagttgtggtggctcgcggggtgcggtgtagggtgctgagaccaacaatggtaccgataataagaacagtgataatcggaatcagaatttttttcataagaaactcctaacgaataaaattgtaaaacgtaaatattactatttacaagaatggcatttattgctattctttaaaacgtaatgattactatttaaaaagggagtggcaattgtgaaacgtttgtggctattactaggtggacttgttattggtgggggcttgttaacgggctgtcagtctaagtcaacgactgctgaatcgcataaggtcaacattgttgcgacgacgaatttttatggtagtgtggcaaaagctgtcggtggcaagcacgtcagcgtgacgtcaattatcaacaaaccgtccgttgatccccatgattttgagccaacaccaaccgtggctaagacggttggtcaggctgatctcgtcatcgctaatggcatcggctatgatggctggatgaacaaggtcgtgcactcgacgcaacgagccaaattgattcgggtcggcgaggacgtgatgcatcgcaaggaaggggctaacgagcatctctggtatgacagtgcaacgatgcccgccaccgcgaactatctcgctaatcagttagctaaaaagcaaccccagtatcgcacgtattttaaggccaacgcccgcaagtacatcgccacgcttaaaccgattcaacaggaacaggccaagttacgagcgaaggctaacaagttaaagaatcggcaagtgttagtcagtgagcccgtctttgattacgcattgaccagtttagggtttaagattgctaatcaagactttgaaaatgcgattgagaagggcactgacccagcaccgcaagttatccacaagatgcagcaggcattaaagagtcggcaagtcgccttctttgtgaataacagccaagttagtgataaattagtgactaacatggtgtcattagccaagaagaatcaggtgccagtgttgaatgtgactgaaaccatgccagctaagttgacttatcaacagtggatgttggcacagtatcgccagctcaaccagttattgtccgattaagggacggacctgcaaggcgacgacgcccgattgcgcaacttggacgggggaatacaacgttagcatttcttgaaccatctgtgttaccggcgttcccggggcactgccgacttgaacggcggtgtattcgctcagtaaggattcaaaactagcgaaacgcgtgatgtcgatgagctgagtggtgagctgctggccagtcgtcagatcgatgaaatttacaatgtcaccgacttgtaaggcttggcgttttgcatcgtttaaacggatttcaattgttttgagccccgattttattaacagccattgtggatgaatcaattgcatggtggtcattgaacgtcctcctaatcagtttagtcttaattatagtggataactaacgaaataggggcctaaataatggcaatgatgtgcctgaacaccggatattagtggtaggtagctggcgcctgtctataattaggttaacaatacaagggggatggcacaattggcaaaacgaacagcgattccagttagattacaaatcgttggcacgatgagcgcgttaatcatcatgtatgcgtggggccgctcactaatcggccagccgttgcaattgggcaatcaacagtttacttggttagggttggtttacttgaccggcgcttttctattcttgttagtggccccatggctgaccaatcgcttagcgttgacgccgtttgacttcatagcgatgacggatcatctggcaatggggtggttggggtatcttatcctaattttagtcgttccgatatggtttcagccggccaattccgggcttacactcggcgtgctttccagtgtggttggtggaatttgtatggatgttccacagaatgtgacctggggtatccgggtaccctggacgtacaactcgccagtgatctggaagaaagtcaactggctgaccggactattgttattaatcgccagttacggcatggttggcatcggctgggtatggcccacactgttcccaatctatcaagtgagtgccattgtgggaattatcgtgattgcgttgggctatgcgcaccatttggcccacttgacgtaagttgtgttggtgattattaacacggcaaattgatatacgcggatcataattaggggtcgcgagtggcacaagtcacgttaatcgtggttagttgaagcgttgttaacaatcgttgaacggcaaaaaaggctggaaaattccagccttttttagtgtctttttaatagagggcccaggcttgcatgccttgtgcgtggtacaagttaactgcggcgtcgatttgttgttgaacggaaccaccactaatatggatgttttggaataaaccgtatgcaccgcttgcgccgttaacgacgtgtggctgccagttagattcacgattgatgatgtgattccaagttccggcgtcaacaccagtccgtgcttgcatttgaccgagcacgtaactttgtaggttatcacccgaatagctttcagttgccggggtagttgctagtgccgaagcaaccgtctcgttagtttgtgctggtgttgtttgagtcgtagttgcggcctgtgtttcagctggctgggttggtgtggtgaccggtgcctgctgaactggcgctgaaacgaccggtgtcgctggtgcttgactagtaaggtcctgggcgttcgcccctggaatccgtaattgttggcctggtaaaattaaatggccgtgaatgttgttggctgtttcgattgattcgatcgtcgtcttatattcttgtgaaattgcccagacacagtcacccttcttaacggtgtaagttgagtcggcgtgtgcagaaacagttccggccaatagtaggccaaccgttgcagcggatgttgttaagattgtggttaataattttttcaagttatactctcccatttttgtaagcaatcagcgtgtcgtacaattgttgatcaacaaaaattagtatagcggcgacttattactcgcatgtgtcgctaattttaagaagcgattgcgagattctgagaaaattatggggagcaaatattttactgaatagttgaagactatcgtgacgggacgtatcggtgacaatatatcggctactaatataaaaaatatgacagaaatagcaatataataattactgaaattaccgatagttgagccagttagcaaaaatagcggcaattacaatgtttaacgtgacattcccaatattaaatagttaataccggtattgttcttataagtttaaaagggtgttgattatagaaagtaatttaccgcaacaaaaaaagtcgggaaggattcccgactttgtcttaatagttttagattaaagggcccaagcagccataccttgtgcttcatataaagcaacggcagcgttaacttgttcttcaacagaaccactgctgatgtgcatattctggaataacccgtaggcaccactagaactgttgcggacgtatggttgccagttggattcacgcgtaataatcgtgttccaagtcgaagctgagacaccagtccgtgattgcatctgacttaaaacgtaactcttcaaattgctaccggtgtagcttgaagtcgtggagtcagttgaactcgttgaagtggtcgttgcgttgctagttgaactagaactagtcgttgaagcacttgaactcgttgtgtttgaagtcgttgacgaggcgttgttatcagaactggttgaactcgtcttaatagatagtttttgaccaggtaagatgtagtgacccttgatgttattagtcgtttcaacatgattaatagttgtgttgaatttttgtgcgatggcccaaacggaatcaccgctcttaacggtgtaagttgagtcggcgttagcattgaggacaccggcgaataataaaccagcggctgcagctgaggtagttacgattgtacttacaagttttttcaaattagacactcctataaattttgtgattatcgattaaataagttactgacaaaaatcttaactgcgatgtcattcgcaatcaacagaacccagtctaacgcctccgtgttacttgttagtgtcgcgagttttaagaacgcaatgcaaagattacaagaatacggacttttgtaatcttcgtaaccgaactgtgactttgaaaaaggttggttaaatcgtttgataggggacagtgacaagctaagttaaccaagttgaggtttgcctaaaattaacattatgacgtgaaatcacccaaaattcagccataaaaaaagccgattattttagtataatcggcttttagtgcttgaaaatggcctcaaacacggctatttaacagtttattccgtcactggaaatggatctgctaaaccgagggcttgtttttcagacttcgcttgagcaatttcctcttgcactaattcacgcgcgtgcggatcactatataggtttaatttgtaatccacttccttcagatttttcatgatttgggcttgctgagcaagaatagcattgcggtgagtcgtcagcagctctcgtcgttgtgcaatcgattggggacctgccatgacataactgatatattggcgaatagcactgattgccataccggtatttttgaggcaaataatcgtatgtaatagatgaagatcaccgtctgtaaatgctcggtagccggattcattgcgactgacaaagggaagtaagccttgtttatcataaaaacgcaaggtgtacgcacttagtccgaccttatcagcgacttctttaatcgtataggtcaaaaagattcctcctaacacttgccttagagtattgtctaaggtttatattagctatattaacaagccatgatgaaaaaaacaaccaatattccgggggaattaaacatgaataaatcattagtattagtcactggcggtaatggcttcttagccagtcatatcattaaacaattattaacagcgggctatccggttcgggcaacgttacggtcgttagataaagcagctggtgtgaagcagacgctagcgggtacacctaacttagatcgattgacatttgttgctctggatctgacacaggatcagggttgggccgaagcaatgcgtgacgtgacgtatgtgatgagtgttgcggcaccagtatttgttaatcaaggtcaggcttctgatgaggtcactagtgcggccaaggtcggcacgatccgtgttctaaaggcagcgacggcggccggtgttaagcgggtcgtcatgactgccaaccttggtgccgttggcttcagtcgtttggatcatgatcatcccgtcactgaagtggactggacccgcgaagaccaaccggggctttcgttgtatgaaaagtcgaagttggttgctgaagaggctggctgggcgtattgcaaggcgcatgctgatagtccagaattcacgacggttaatgccggtgccatgcttgggccatcgcttaatgggcacgtcacgggtagttataatctagttagtcggatattaactggacagatgatgccaaaccttaaagtcaatgtcatcgacgttcgcgatgtcgctgacttagaggttcgggcgatgacggcgcctgcagcggccaatcagcgttttctagcagtggccgccacaccaatctcgatgcgggacctcaaaacattgattcaagaacaacggccgcagttggctgcaggcctgacgaaacatttgattccagactggtttgtgcgggggttagccccatttagtgggcaattacgcgagtctagtttgatgatccgcatcaatcacgaggtcagtacccaaaaagcccagcaattgttagggtggcaagcgcgctcagctgatactgcggtattagccgctgtcgatacactggttaagaatggtttgaataaataggacgatcaaaacggtctagcagtagtatttactgccaggccgctttttgtagctactttagtggcaaccggacttagttattttaacaaaagtatatatttttaaagtaaaagtattgattttgaaatagaaataggatagtattatttcacgaggaaagcgttttccaaaataaatgacacagaggaggagtttgatggataaggagcgacagatgcccaaggattttttctggggtaattcagtgtcaagtatgcaaactgagggtgcttgggatgaagacggtaagggtcgttcagtttatgatgttcgtcctgcgacagcaaccacttcggattggcatgatgccattgatgaatatcatcgttacgaggaagatcttgatttgatgaaggacttacatttgaatatgtatcgaattcagatttcatggtcacgagtagttccagatggtgatggtgagtttaatgccgctgggattgcgttttatgatcggctggttgatgcgatgctggcacgggggattacaccgatgatttgcctgtatcactttgatatgccgttagccttagctgaaaatgaaaacgggttcatgtcgcgccacaccgttgatgcgttcgtccgttttggtgaaaagatgattgcccactttgctgaccgggttaaatattggatcgtgttcaatgaacataatttatactttaccgacgaagtcttcaacatttcagggtacaccaagggtgatcaaagtgttaacgacttataccggattttccaccatactatgttagcgcacgcgcgcctagatgactttgttcatcagaactacgatgacgtgaagattggtggtatgttagcttacaccccggtttatccagaaacagctaagccaattgatattatggcggctcgtaagagtgacgaatttttgaacaacaacttgaatgacgcttacgtgcacgggcactattcaccagaagtcctgcgttacgttgaacaacagggcatcgattatgatttgcaaccaggtgatgaagcaatcattggcaaaatgaaagcggattttttggcctttagttattatcgttcaacggttatcaacggggataaaatacccgttgatgccgttccgaatcgttatctcaattattcatttgaggccaaccgttttttacaagctaatgaatggggctgggcgattgatccactcggtttccgcaacttgattaccaagttgtatgaccagtacgaagtacccgtgttcccgattgaaaatgggattgggttacgcgagcactgggatggccagcatatgatcgaagatgatgagcggattacttatcatgaagaacatatcaaggcgatgaaagatgccatgttgatcgacggcgctaaggtactaggttatctcggctggggcttgattgatattccaagttcacacgcagatattgaaaaacgttacggagttgtttacgttaaccggagtaatcatgatctaaaagacttaaagcgggttcccaagaagtcatattattggctgcaaggggtcctagcaaaaaatggagatgaattgtaatggaaaatagtagtaatggtgctgttagcaatttcattaacaacaaagttttaccgccaataatgaagttcgttaacactaaaccagttaaagccttacaagacgggatggtctacgccttaccatttattatcattgggtccgtattcttgatcttatctaatattccaattccagctgtggctgctgttattaaggcctctggttgggcagcgttctttaaccaggcctatacagtaacgtttggggttctctcactttgggcggccgttgggattgcctatgtgtatgtgcgtaacgaagggtatgaaccactgcccgctgggttaacttccatggccgtattcttacttttgcaaacgcttaacattgccaatccattagtagctgcgatgggtaaagccggtactgggattaccaatgctgctgggaatgtcgtgatgtcaggtagcgccgtttcacagaatatcgataaattaccaaaggtcctacaaaattttgtgcaagcacccgttactggggttgttaatattacctggctaggtggtcaggggatgatcgctgccattattgtcggtatcttagttggttgggcttactccgctatgattcgtaaaggttggaagattaccctaccagaacaagtaccagccagtgttgccaaccaatttactgccatgattcctgccggggtcatcttgattgttgcaatgttaatctttgcggccttcagtgctttcggtaatactgacatgttgcaatttatttacaaggttcttcaaacaccgcttcaaggattatccgattcactcggtggtgcgctggttattgcgttcttagtgccattcttctggttctttggggtccatggtgggttgatcatgggtgccattactagtgggttactgattccgaacacgttcgacaatgcttcattatataaagcaggtaagttgaccgttgcccaaggtgctcacattgtaactaatgaattctacaataacttcattaacttaactggttctgggattacgatcggacttgttatctttacgttgtttgctgctaagtccgtgcaatttaagacgattggtaaagttgaatttattccagcattattcaacattaacgaaccattcttgttcgggttaccgatcgtgatgaacccattcttggcaattccattcttcttgacaccagttatcgtggccttatccacttatctggtcatctacttcggcattgtgccaccattgaatggtttcgcggcaccgtggacgaccccagcaatcatttctggtttcctgattggtggctggaagatggctatctggcaaacaattacgttggtcatgtcaactgcaatttacttcccattcgctaagaagtacgatgctatcttaacgaaggaagaaggcgaaaaggccgctgcggaagctgctgctggtaacgctgaaattgaaaagatgtaattatagaaaggaattaaataattatggctgaaaaaattattatgttggcatgttctgcgggaatgtcaacctcactattagtgtctaagatggaagctgcggcaaagcaagatggtgttgattacaagatctttgccacctcagcggctgatattgaccatcaactgagtcaagatccgcatcccgatgtcttgttattaggaccacaagttcgctacatggcgaatgacgtgaagaagaagactgataaggctgggattccaatggatatcatcaatatgtccgactatggcatgatgaatggtgaaaatgtcttacaagcagctgaaaagttactcggcgacagataattaggatttaaccggggaagtcaatgcaatcgtgaatcaccaacgtgtgcggtggttgctttaacatgattgggacttgtccgagtgataatcaaacactaaccaaatcctagattgttttggtggtgggcatctcagaatgttataatatgttacgattcctcactggctaaatgctggtggggaatttttttgtcggtggctggggcccgcgatacggtactgcgagggtgtgcaagcgagtaagcgagagaagcatttagtgtggacgttactttggcagtgcttaattttaaaggacggctgctgattcaaaatggctattaatcaaacaaattaaataaaacccttgacctgaaacccgttcgagcagttaggataaaggtaatcaaagaacggcagctggccagcgccattatggaaatctattcatcaaattcaggagggttttatcatgggactattttcatttggtaaaaaagttaaattatatgcaccagttgatggcacactgatagatttagccacagtcgctgcgggtcagacggggtttgcggtgacgccagaacgccaccatatcttcagtccagtaacgggaaccgtcagtgccctgattccagaacaaaatgcgatcgaactggcagctggaaagctgacggtacggttacgaatgggtgttaataccagcgcaactccggcaacttatgttcatgaaggcgaccaagtgacaccagaaacaccactcgcttttgtggatcaagagcaggccgctgaaaatggggaggatatgacggtgttggtggttgtggataaaggtggacaacccgctgaaaaaatcagtttatccacaagtggacaagtgagccacgaccaagaagttgccacggttgttgctaagtaggacggatgatggggctaatcgtgtgtaattgtttgcgatgagctgagtcagaagtaatttcatcgcgtcaccatagttgattgatgcaaggtcaactagcaattgcaatgcagttgttaaatacgaaaacacacttcaaagctgctacttttgaagtgtgttttcgtgttcagttgatttttgattggcggttgcaagcaattcaatctgccgcagaatgagcctgtccttgtccacaagccatcagttcagcttggtaggcatcattgatgcgattgagtgcttggtgaaattccgtgataactttgttcatttggcgctgatacttttcatccaacgaataaccgttttgaacttgagttttaggccccgttgtttgattcaagtacgcctttaagtcatcgtctggctgtaacttttcgtataaatcgacattgtctagtaagcggacgatccggttgtatttacccgtaaaggtccgccgaataatctgtattcggtgacgaaagacatagcaaccggcttgaatgacggcttgaggttctgggtaggttgtcgtttgttggtagtgttggacgatttcaggaacaatctgccgaatcgcattattgatagtcggtgtaattaaggccgccgcgattttagttgggtcggatacgccctgttcagtctgtgaggccgaactgaacaagtcactagaaagaatgttcggattggtcgtagttaggtccacatattcccatagtaggacattgaattctgaatgattgagaccaccattttgaaagacagcggtgacatattcagtcaaactaccgtataaaaggtaattagtggatacgtcaaagtatgcagctactttagcgagtcggtccgcgttagctagcgtacgtcccttttcccagtcattaattgtactttttccagccaagccaatcgcagatgcaagtttggccatacttaaaccagcggcaattcgaagttggtgaatacgattaccaacttgttgtttatcaatctgcaatttgatttcccccctgattggttcttagtatattctaacatagggagggaagcgctcgcattgttaacactgaatatattagcactttcgatgattggtgtggtaacgacagataagtagtatcaagtgcttagtgatacttatgaataattgtcataaaagcggtgctattatttaccggccagccgtctagttggatttcataaggttgttcagtaccaggataaatatgaccgggaatcgcaaccttttgccggtggtcgtgaatgatcaggaaaaacatcgcaggtcgacaaaggatggtcacgtgtgcggccaggcagtcgctaagcgtggctgctaaatgctggcgaatggtcgttagtcccgcagccccttcattaataacgatcgaccaatcgaatgccaagtctgaataggcggctaatggtgttaattgttgcatgttgaatgcctcctccaaggtattaattagactaaatattactattagcatacatgcaaatagttgtgatgacgaccatctgcgcttgttatggccaattaataagctggcttaacagagatcatgcgacaagtgtaaattgccagcgtatactagaagtattatgtgcaaaaggaagtgtcgagaaatgcaacaccggattgctgtgctggcagatattcatggaaacttgacggcgcttaatgctgtgttggcggatgcgcgtcagcaagccgcgacggattattggttcctcggtgatctattcttacccggcccgggtgccgaaaagctctaccagaccttagcggacactgcgccgtcagtatggttgcaaggtaattggaaacaggggattaatgcggtcatgactggaaacgggcgactggatgatccttcacagatttattttgcacgattgaccgcgtatctggtgacccatctgagcaaatcgcattacgctgaattagtgcaacggcccattgcgacaacgatggtcgtgaacgggttaacttttcaactggcccataatcagccggaacgctcgactggtcacgacctgtatccggatgaacgccagtctaattttgatcacctagctggtgatgcggatgtggccgtttacggccatacccaccaacaaattatgcgggtgagtcagcggggccagctcattattaatcccggggcgacaggccaaccttatagtccatacgctaagttcatggctgatcagcgtgctcactatgcaatcttaacggtggatgacgcgggtcgaatcagtgtggattttcgaaaagttgattatgatattagccttgagttgaccgttgcgcgtgaacaacaattaccatatttagacttatatgaacatcttcgccggactggttttacgagtacccatgaccaagccttattgggcaaactgaacgctaagtttaattacgctaatgaggtacgacgattttttggcatgcaagcgtgatagttagtggtaagttagtgagttaactcttataatgattgaacaggatacgaggagggttttcatgaactttgcaccatcagaatggtttggctttaacaagcgagctagacatgatatgacgtttactaagactatcaatggcgagaccagtaccaagcaagtgtacgggcactttaacgtgtgggccctgttgttcacgtggttttatgcgctgttcagtgtgcggtgtcgaaccccgtttttcttactgaaaacggcggtgccattcttaggcatgctgtcgttaaatatggtgacgcagctgttttttagtgaccaagttgtcatgagtatcgggttactaggcgatatttggtatggttttatgtttgagacgtggtttagaaatcagctggttgcaaatggctatcaacaaacggcttagtgcgacaggaatagattagcttatcaggcttcccagcaagacgtggggagcttttttgattggggtcgttgacaagtttctggctggtaaagtatcgcaacataaataatatcgtttctttacaaacatctgactaaacactttacattccttaactattcttaaaagtgcagtttgttttacgataaaaaagatggagtgataattttataatgataaagccgcgtgttttaacgaccttattagtttgttcagcaatcttaacaacgacggtgaccccggccgtcgctgcagtaaccccgatggcgactccgagtgagcaagttgccgaaccagttgccagcccggccgttccaacagcaaccttgagtttggcagttcaaaatcaacaattggttgatttaattgggcagacgcagtggcaaacctatgggcagcctgccgtgacgaaggaccctgaatttaacgaccaagtgttgaacttagatggcaaatcagcgttttacacgaccttcacggatcagcagtttgcaaagttacagaatgggatggcgatcgaggcgtactttaaatatgatccagccgccgatgccaatggtgaacatgagatcttttctagccaacagggtggtgggttaggacttggggtgcaaaacaatcaagtcgttttcttcgcccatgatggttccggctataagactcctaaaggcaccttacataaggggcagtgggtgcatgcggttggtgtgatcgataagaataagacggctagcttgtatttggatggccagttagtccaacaagtggctatgcccggtgatttaaagctggcacaaggaaccaaagactttgtgctgggtggtgacgcggttcctggaagtcacgttcagtcaatgatgaccggccaaattagacaggcccgcttgtatgatcagacattgacgtcgcaacaagtaagtcaattgaacgttgaagcacaggtcggcaagcagccggtcgcacccgtaccagtcgaccaaacgattgcgacgaagctcgttggcccgaagcgaatcgcgagtgggcacacttatggccttaatgtacatgcccggcaaatcaaagctaccggtgccgccccaatcaccatggatgttgtgtatgacgcggctaagtttgactatgtcggtgcagaacgtctcttacaagggggaaagacgcaggtccaactgattgcgcctggccgtattcgcctgactacgacggcgaacctttcaaaagctgaatttaaaatgtatgcgcaaacgcggttagcgcaccttaatttgaaagctaaggccgctggtgagacgcagatcaagtttgagcagctaactaaagatacaaccattgaactagggccagctcaaactgttgaaattcaaggtaagtacgcgctagattacaacggtgacgggattattggtgttggtgacgtggccctggcaaacgcagccgataaagtggcagccgccaatgcagctgaaatcaagccttataaacacgtggtcgttttaacgactgatggtggtgggaacccctgggatccgaagggaatgtactatgcacaaggtgcggagcaaggaactaagactcccgtatggacaaccaacccagaaatcatgaagaaacgtcggaatacgtatacgatggacttattcaataagcagtttgcaatgagtacgtcagcgcgggccgtttcaccagcgatttcggcacaaaactacatttccatgttacatggtcggccatgggacacgctacctaaggaatatcaagggactaacgcgaccatgggacaagaatactttgcagactttaacaaaccacaagcaatgttcccatcagtatttaagatgttacaagccgataatccaactcggggcgctgcggctttctcagaatggggaccaatcgtcaatagcatcattgaaccagatgccgcggtgactactaaacagtcagcttcgctgaaatcctttgatgatgtggctaactatatcggcacgccagaatttcaaagtactgggttagtctacatgcaaagtgattatatggacggtcagggacacggtcacggctggtacaatgacaattactgggataagtacgcgcaatatgatgcgctgttcaagcgagtaatggataagcttgaagcaaccggtcacattcatgatacgttagtcattgccaacgctgatcatggcggttctggcaagaatcatggtggttgggatgaatataaccgcagtattttcatggcgctcggtggcgaaacggtcgataatggccgccgtttgcatggtggaagcaatgctgatatcagtgcgctcatcctgaatgctttgcaagtcccacagacaccacagatgtttgacagtcaggtctttgactcatcggcttttcttaagcagactgacctatcgaagaagaaacgttcagttgaaacgttaaagctcagtcgcaatgatcaggaagcaaaagttcaattgactcataaccaaaaccggcaactgacggcatttgatctgcaattggacttagcaggtcgggaagtcgctgacgttaaggttccaaccggcgtgcagattttacggcagacggtcgctaatggtcaattaagattaacagtcagtgccagccaacccgtgactgacctggtgacgattaaattcgtaccaagtaagacgcgtgcggctaagaccatcatgttaagtcaagcaatggctgccactgccgacggtacagaagtgcttgtggatttggataatgataatccactgacgagtacggctaaacccgacgaaaacggcagcacgacgactaaaccagatggcaatggtactgcggtcaagccggatgaaaatggcagcacgacaactaaaccagatggcaatggtactgccgttaaaccggatgaaaatggtagcacgacaactaaaccagatggcaatggtactgccgttaaaccggatgaaaatggtagcgcgacaactaaaccagatggcaatggtactgccgttaaaccggatgaaaatggcagcacgacaactaaaccagatggtaacggtactgccgttaaaccggatgaaaatggtagcaacacgactaaaccaggtggcaatggtactaccgttaagccggacaaaaatggtagtagcacaactaaaccgaatggcaacgggactgctgtcaaacccgacaagcatgaaactagcaccacggggagtgggacagttaatacatcaggtgcagacaaaacgagcaccaacgacaatggcacttcaatgacggccggtacagctagttcgcatgcaagtacagtcacggatcgggtgacgagtggcacggtattgcctgaaactagctcgagtgcaactactaatcatggcagtcattcgacaggtcatcatggtagcggctggttaccacagacaggtgaagcggtgcaacgctggctagcagtcgccggcggtgtgttcctcatgctgactggtgcaatcgcggtttggtggcggaagcgacgcgcctaggtaaatataacttggcacgataattttggaagtaagcacggatgaggcagtttttgggaacggtgtgtttctcgaaactgccttttgtgcacgctgatcgacggtggtgatgtcggttgaagtaccagagcgaaccaggttgtaatgtcactccttaataattaatttcaaattatttagcctaatagttagtttttgttgttatagtctaactaaagtgctatgataagattcaataaaaataaggtataagattttttccacagttgtttttttggtaaacttaatgactaatagtcacagttaaagcccttgatataaataaaggggagttggcacacgatattgacgtacagtaaggtagggtgagcgaggatgagctacttagaattaaaagatattcacaaggcctattatttaggcaaggaagctttcccagtcttgaatgggattaatctaacttttgaacgaggtgaattcgttgcgattttaggggaatctggcggtggtaagtcaacgttgatgaatatcattggtggcttggatcggcaatttcagggacaagtgttattgcaaggaaccgcgttagatcatcaccaagagaaacagatggatcagtatcggcgtgaaacagtcggttatatttatcaatcatataatttgatcaaccatctgtccgtgttagacaatgtcctgatctcgttagatatgaccaagttaaatcggtcagaacgtgagcaacgagctaagcaactgttaactcaggtggggttagcggatcaaattaaaaagtacccgaaccaattatctggtggccagaagcagcgagttgcgattgcccgggctttagcgagtgatccgcagattattatcgcggatgaaccgactggcgcattggattctgaaaataccacggaagttttgaaaattttggatcagattgcggcggaaggtcggcttgtaatttgtgtgacacattcgcaggatgttgcgaatgcgggtactcgaatcgtgcgcttagctgatggtaaaatcacggatgacgagcgggtgaaacccgcttatccggtcgatgaaaatcgccaacagattgcggcacgtaagttaccgtggtatgtgccactgaacacggcgtttaaacatctacgctatacttggacttggaacttgattattatcattgggacagcgattggtttattcgcagtgatgttgtttaacgggttaggtaatggcctcaaggggtatattaatcaggaaatcaatgatatggtcaatccccgtgtcgtgacagtgaatcggtatcaaaaatcgagtcaaagtcagcgaggcggcagccaagaaggtaaccagcaggcagctgccatgggggcgagtgtggcgacgaccaatcagccaacgttcagtacggcccaactgagtaaactgaaaaaagttgcgcatgttcagaccgttcagccaattttgagtgcaagcaacgcgacaattacagttggtaataaagactacaccgcttcatcgttaacaacgtggacggcttctaaccggaagtcgattattaaagctggtcacgtggctggtaagaatgaaatcgtcgtcgataagagtagtgtggcgaagaaatggtcatctaagaattggaagcaattggtcggtaagaaagtgactgtggcttttcagacaacgaataagagtggtaaaagtgtcacggttaaacggcaattaacggttgctgggatcacggacagcacgactggaagtggtgtgaacgccgtgacctacgccactatgaaagatatgcggtcagcaaagaatttaagtacgcagccaacttcagttgcggtgaaagttgattcgcgggagcataatgatgctgtaaccaagcagattaataagctaaagattgatggcaaacgggtttaccgtgccaccagtattgccagcatgcttgatacggtcaatacgtatgttaacttagcaaccacgattttggcggcaatcgctggaatttccctactagtctcagcgttaatgatcattgtgaccatgttcatgtcggtcagtgcccggaagaaagaaatcggaatcttacgtgcgctgggtgaaagtcgccgtgatattcggcgattgttcacgagtgaatcattgatcattggggtcatcagtgcactactagctactggaattgcttatggtattggagctgccttgaataaggtcctctaccaaatcgccagctacaatatgattgagattcaggtaagtaatattatctcgacctttatcattgccctggtgattgccttattagcagccatcttaccagcttggcgcgccgctcggttgaatccaatcgatgccctcgccgctgattaagtaattgtgagtcattaactaaaatagtctgttagtaaaacggtaatgaagcccagaatgggtttcactaccgttttttgtgcgtggggcctttgatgctaatttgctttacatatgtcgaaattgacatataatgaagacaactaaatagaacacacattgcgcgagccaatttgtcatgaatcgtgattaaaacgtgccaagtttagattgttgttcgtcagccggtgcgcgtcctaatccgacctccagggccgggtgacaattgctggaacgcagccgacgtcgatttgagctaacgcataacccgcgtcatctcaaatacgagtcttattctaagccggaagcaacccacttccagctaagaataatttggctactgagcattgtcaccagcccctccagtcgggaagccgctcgaatggctgatgaacggccactgaactcggtacaatttgtcgttggctattttgatactgaaccctttcagttaaatatcagagtgccttctccactttttcgaaatattcaattattactacggtaatttagaaatagtgagttatcacaagactttttcaatctgacagttgattgagaaaactgtcagattgaaaaacaacgacaaattcagcaaaagttgagtacatccctatcagccattcgaacgctatcccgactggaaggtgtttctgacaatgcccaccacgttccggcaattggcagaaatgcctggaggtcggtgtaggacgaattaactaaacaagtttacgctgagtcgaactttcccagcggtccatagctggctgcttttgaacttaaaaacttggcacgttttaatcacagttgatgctaaatactagcacaacgcgtaaagaaaagtgggtgaaatgatgcattatggggttttagcgttaacgtttttgagtgtcaatttggattttttcttgatgttagtttttttattgaagaagtatcggttgtggcaggtcttgttgggctatttgttgggcaatcttattctactaacggcaagcttctttgtgggtaaagcactgaccttatttttgccagaatggttattaggattcttgggtgtgctgccgatttggcttgcgtttcacgacgatgatgatgataccgccgatcgggctggtgggtcgccggtgattaacgtactagtcacttatttggccgtatgtgctggttgtaatttatcgatctttttacctgtgctcgttggggaaagcatggtacactttgtgatgactttaggatttattggtatattgacgatgcttgtcgtgcttatcattaaccaggtggcggaaatcaaggttgttcaaaagcaaatagcggctcatggtgaacggttgatgaaaatttgttacgtggtgattggcttatatgttttctgggatagtgggctaattagccatttaatcgcattcctatgattggtgagaacggaggaactggcatggaggtcagcgggccactattaactgaggcggctaaaatatacaaagtactgagtaatgttaatcggattaaaatcctaatttttttagaacaccatgaagcggacgtcacgcaaatcgttgaacatgttcatttggcgcagccattagtctcgcatcagttagcaattttgtttcagtatcagttggtatctaaaacgaagcgggggaagcatgtctactattgtctagacgatccccatattttggaaatggttgatgccatgattggacatgtggctcatgaaattaaacatgaaccgcatcatgattaatgacgggaggaagttgtgaaggttaagataacgaaacgacagcttatcagtggggcagtactgctagcattactattaattggactgttgatctatcgctaccatggtacttgggagatcattcagcatcgggtatttgatcaatcagcactggtggcccaagttcgacgacaccgcgcgattgatattttattagtagttcccttattgatttgcttttcaattattccaggtgcccccgtggcgacgatcagtgtcgttgctggcatctgtttcggcaaagggcttggggcagtgttaaatattattggcattacgctgggcaacttgattgcacaacgctttttcggacgggtaacggctcgacgtgatcaacagccgtcaaaactcgtgacggccattggtaagatgcggcaccccttattaggaatcgtgattgggtatacgataccgtttattccaacgtcattagttagtttagcggccattgaaacggcggtgacaccccggcagctagccgcagcaacgctactgggcagcatgcccacggcgattatctatgcttggggtggcgatgaactgattaaagcgcacttcaagaatgcgttgatgttggttggactcttggtgctcttattgggattgttgtggttgatccaccatgatcgtcaacgagcagttgatttggatcattaataattgaaattataagcggcgggcacgccttcttaatcattgactaagagggtgtgcccgccgctttgcccgtagccgttatgatgcaactggctgggtatgcttgaattgattgatttgagttgtggttagtgtaactgtcttatatggtaagaaatgttcagacagttctgagcctggatcggcctgaaagatctcgaccgtgtcgtcagctaagtctagctgatagacacgccgcgcatgcgggctgtcaacataaatagcggtagcggtgaagggccgccaggtaaaattagtcgccggtaataagtgccattgttctaatgcgtcgtaggtttcgtttggtgtcataatcgaatcccccttcagtgactattatagtatgtttaggctaatagtcaaataatgtttgacgaacctaaaacccccgtttccacattgaaaacgggggttttgaggttattttaattgatttaacgaataactaaaactgaaatcggtgcgtattttgccatataagcagcttggctaccaaagtgtttggcaatcccctttttggctagggagccaataatgagtaagtccggttgaacgtgggggatgacttccttaacgatggtctcgccaggttcgccttccgcaatcattgcgtggactttggtgacaccagcagcttgggcttgcttttgatatttcaaaatatgctgttcaagttcttggcgttcaccatgaatgtagtctttactgagcgcttgatagacgttcatttcatcattttcaagaatcgagataatgaccagttcggcaccatcttgcttcgcttgatggattgcatagtcaaaagcaagtaaagcatcggcagaatcatcaacaccaacgagaatccggttgaatttagtcgccattatttgttggcctcctttgctgctgcagcaagttgctgttcaacgtaacgtttattaccgcgttgtaggtcgaagacggtccagacaagtagggctaagatagcggcaatcaaaaggtaggctagaattttagaaaaagtctgttcgccagctgaaggattatcgccaaagaagcctaagattgaatctggtagaccgagtaagtttaagaaagtcaaaccgatgacggataaccaacctaaacctttgatccaaagtgagtttttgaatcgtttgcccatttctgccgcgctgtcagtcatcattaatagtggcaacatggagaatggaagggcgaaagccagaaagacttgtgagttattcatcagattattcaatgcagtatgctcgtcgattgcactcttaccactagttaatagcacgcaaatgaggacgggaataacggagatcaaccgggtcactaaccgccgtaaccagagtggcatccgcatgtggacgaacccttccatgatgacttgcccagttaacgtaccggtaattgtggagttttgcccagaagccagtaacgcgatggcgaagagggctgagagcgccccagatttagcaacactgattaaaataccattgcttaacattgatgtattggataatgcttcataaagaccgaagaatgaaggatctttaacagcgccactcttaaagacggcaacgcccataatcaataatagtgaattaaccacgaaagcgaatgaaagttggatattggaatcccaagcagcgaatttaacggtccgcgcgacatcttcctcatcgttgtggtcaatcttccgcgtttgtgagatggctgaatgtaagtacaaattgtgtggcatgacggtggcaccgataatccctaaagcaccagaaagtggcgtcataccgtttactgaacgacttgtagagaaagtgtcagcggttgggactaggcccttgatcacaccgccccaatcagggttggacagtgcgacttgataaacgaatacgaataagataactaaaatcaaacaaaccacgatggcttcgattttccgaaaaccgattttggtcaataatagcaaaactaaaacgtcaagcacggtaataaacaccgcaatgactaacggaatgttgaataataaatagagggcaatcgcagcaccgataacttcggcaatgtcggtcgccatgatggctaattcggttaaaatccacaagacgattccgagtgatttactcgtccgcgctcgaatcgcttgggccagatccatctgactcacgataccaagtttagccgccatgtattgtagtagcatcgcaatcaaacttgatatcaagatgacagacattagcatgtattggtagttttgaccaccggtgatggaagttgaccagttaccgggatccatgtaacctaccgcaactaaggcaccaggacctgaatacgcaaagagggttttccagaagttcagattcttgggaacctcgatggtaccgttaatttcctctagtgaggggccgttagcatattcaatcaatttatgcttccggtttggggtgttcgtcttttcgctcaattaaaagaccacctttctatatctctaaatctttgagccgttgtcattgtacaataaataaaagtaaatggaaatacttttttaggtatgcctacaaaataattaaaacagtttgatataaaacattctaattgataataatatttttaacttactaagcagtcaaccaagcagactaaaacgctatgacggaaatcattgtcgtagcgttttggttcgcgattctcaaaaaatacaacacgcgcaaatcgccggcttcatcgacttgcttagaaacttatcttgccgaacaatcacccgtctcgtacgatgtgcttggaggtgtgaaaatgaatttttcagataatttaaaaattattcggcaacaaaagaagatgactcaaactgacatcgcgacacaattacacgtttcacgacagacgatttcaagctgggagaatggtcgaagctatccagatattggcatgttggtgcaaattagtatggcgtatgatttttcagtcgatcaactattgaagggagatttagggatgttaaaacactacgaggctcagtcggcaaataatcggcggcagcagcgcttggtggcaatcagttatgacttagtcgttggcctactatttttaagctatttgcactattttttgcattggaacgacggcatcgtgacgatggtcattaatggtgggttgattgtgatgaccacgacgttgattatgaattataattattttgatgattgggcaaccactaaacgccaggcgtggcaattagtgggggttattacgatgttggcggttttaaatatcgcgttggtgtggccacaactagctagtcagatcccatcaacccagttcttaaatcaacatgctggtgcatatttagcggggaatgtgagcggaaaattagttggtgacttcttgcatctctttatttggacagcggcggccgtgatggcgattgaaatttcgctcaatcgggcgagaaagacttcagattaggtgttcaggttgtggatggtgttattaagtgctgcgaccactatttagcagcgatcgagtcacgctcaacggtcattttggcacctatgataatgatgagttatcggctacggcaagccgtttttaattcatgattgtcgcagattttggttattcgttgatgtgcaacggccccatgatgatgccaactagctgcagaattagctgatgcggacagttaaagctggttggcgttttgtgtatgtgaattattggggtaaaactgaatagttgccatcgccaatagttaactgctgtgctaagattaagttgtgttatttttactcataaaaatgaagatacaacttaaacagaattctttcacaataatcatgtttaagtgaagaaagtcaggtgtagtaaccatgagtaagccagattcgattaaagttgatcaaaatgaggaaacggttactgaaattttagagccagcagcagaattagataaaaaaattatttcacccgttaaagaaacccgtaatcaggcgattcgctatatcttgtggggattgatcagtgttgcggtcaactttgcaactttctatacgatgtaccacctaatcggactcgaataccaggtcgctaatgttatttcctgggtcattgccgttcaagtcgcgttctgggtggaccgcttgaaagtgttcgaccatcattcacaccacgtttatcgtgaaatgggtaagttctatgcgacccggatcgtgacgtacgtcgttgaagcgattattttatggttgttgatgtcagtattggggagctcggcggtactagccaagattcttgggcaggccggcgccatcattgggaacttcttgttctcgaaactgtatgtttttcgaaataagtagccacatcaagacgggaatgaaaattcacgtctttttttgttcagtggggtgccgcggttgttagaatgacgagtaggtgtgtgaaagcggattaagattacaagtagattgcggtaatcctaaatattcttaatgattcactaagagctatgtttaagcggggtgtcatgtggtttaataaacttaaattattgcttgtcaccatgttaaaaaattaagaggagcgcacagcatgctaaaaaatctaatgcgcggaatcaaagcgctgtgtctaatcggcctcgtgttatttgggtggcgcaactatgatacgcttgccccgcgcgcggcagctttatatcagacgagtcgtcagaatctagcggctgccttgtcgggtgacttatctagtcatttgttgggtgctgatgatactagcagtgctaccgaagattcggcgactaactcaagtaagcaatcatcaggtcagcagacggataagactgcgagtgccagttcggtcactggctcgagttcgcaagcaactagttcaacaacgcaagcaacaccgattgaatcgatcgtgcagaacgccaccttaaagaaggcgtattattattccttcgatcataatgttcccaaagcggcccagcaggtctttcttgaagctgtcgcgacttataaccagactgggttagtccatctggtagctggtcaagccagcgggtcacaaaattcagtgactttttcgatgtatcataaaaaaatgacgactggtgcgaccagtgttgaacttggtcatggtggccctgatattactaagcaaatcagctggcggggtactcaatattggaataacgcgacggctagtcttaacggctcatacgcttcagctttcagtaaatcggtcgcagttcatgagttaggtcatgcgttagggttggatcacagttcatcgactgaatccgtgatgtacccagtttcacaaggcaagagcacgttatcaagtgctgatattgcggccctgcaaacaatttatcaaaagaatgcgtaatttattttcgtaataccaaacaaaatttaaccacttttcaaattttgacctataatcaaggtgtatcaaaaattagaaaggaagttgttttagtatggctgcagcagttgaaatgaacagtatgttagacgaaaagatgacggacgtgtttgattggagcgactctaagttacccgtacgggatgcgatttggaatcactttatggacgctgatagtcatgatactgacaagacggctgacgaagtagcgccttatatgagtatggatgaagctaagctcaagagcgaagttgaaaaactcttaaaggcttaactagaataacgaccatgacggcctaatttttgaatgggaactgattgccagtttagtaatcagttctttttatttgaaacaaaataatttttgagcgcactaatctaaagcactcgaaagtgttgaaaaaaaactagtatactaaagctactagctagtatttaagtttgtgggatcaacgtaattgccttgcgttggtcctttttatagtctacataagtggtgccttcatcaatcatgacgtagataattcgtaataatttatgagccagtgcgactagcgctttttgcgcggtcatgcgaccgtgcaatcgccaaaagtagtcttttaaaccggtttccttggactgtttggcggcaagcgccgcgcttaccatggctgatttgagataaacattgccatgtaagatatgagcaccatgtttgataccggcagattcataattccccggacagagaccggcccaagaagctaaatgatgagcatctggaaatggacttacatctgacccaacttcggcaatgattatctgagcaatccgttgactgataccaggaatgtcttgtaggcgaagatacaaatcattaaattccataatttgttcatcaatttgagcatccagttcagccaatacccgcctaaaatcagcgagtagttccatattcaagcccaacaatctccgatcgttgcgtggcagaatgccatccatcgcagcaaataattgttcaacactagcctttatgcgggtgtggcgacattttgtgatggcctgtaaagtgatgacttcaccatctatgagtaacttcagcagtttaaggccagttccgttaaaaatatcggaaatataggtcgttaatttaatgtttgagcgttgtaaaagattatggacttcatttttggttgcggtcatagattgggtaatcttcttacgtaacctagttgattcgcgtaatgcttgaatcgactttggcgggacaaaacttgcggaaactaagccgtaacgcgccaattcggatagccattcggaatccttttgatcagtttttttaccaggaatgtttttaacaattcgcgggttacacaggatcatcttgaaaccgaagggttccaagatttgccaaaccggtcgccaatactgaccggtactttccattagaacttgttcaacatggcgttgcttaagccattcaccgcaatctttaagccgacaagtaatggtttcaaaacgtttcgagattttcttaggcttggcgttagccaagcccaccaatatagaaactgtaatctgtttttgatggacatcaataccagcaacactttcagcaacgacttccataaaactcacctcctaataatcttgaaagcagtaccttcagtcattgagggttgaaattttatttacgtgtacgaaacgacaattgattaatctcatgaactgaaagccatcggttttttatacgggctaaagcgagcaccaataagcacacgatgaacacgaaaccgccttcgcagtcattataactgagaaggcggttgtttcatatcatgattacgagggtagagcgaagcggcgccctcagatagttttttatgcttttaatccggctgaataagctggttggtcaggggggcctctcaaccgaagctaatcaagaccaaaaataatttttttgaattactgtcgacactatgagcccgtagtggtttaccttttaattaatataaaaacaattaaaaattcacttgacttataattaaaagttaattaatctaagaaacatcaacattacaaaaacttttgaaagcgaggcgcgtcaattatgaaaattcaatctaacctaaccaacttgttgacaacccttgctgttcaaaatttagccttattattaacgaagaaggacccggtcacttgaccttgagtataactcaaaattcaagtgaactgagcccttctttcccattgtggtaatgaggctcagttccgggtaaaggcctcattcactacggtggatgaggcctttttgtgacttaaggaggatcggggtcaacaacgtagcaataaaaaaacgaaagtgggaataactaatgaaaaaatgggaaaaacaaacgatgaagattgcagcacttggtgcgatggcgttgacactggcagggtgtgccactgccaaatcaagttcaagtcaaggaaataatcctggcaagactattaaaattggggtcaatatggaattgtctggatctgcggccggttatggagaacagcaaaagcaaggcattcagttagccgtcaagaaaatcaataagagcggtggaatcaaggttggggggaccaagaagaaaattcagttggtgatccgggacaataagacatcgaacacgactgctgcttccgtggctgcccagctcgtgaataacgataaggtagtggccgtagttggtcctgcgacaactagcgccgggactgcggcgatccctaatatgactaaggcggcagtaccatcagtcagtccatcagcgaccgatccggattatacgttgcaaaagagtggcaaagttcaaaagtacatattccgagcttgctatcagaataattttcaaggagccacggcagcaacctttgtgactaagaacttgaaggcgaaacgcgtcgccattttgactgataactccagtgattacggcacgggcctaacaaaggcgtttaagaagcagtatcggggcacggtcgttagcagccaaacgttccaagagggcgataaggactttaatgccatcctaactgcgttgaaacataaaaagatcgatgccatatatgcgcctggttactattcagaaatcggtctaatcgttaagcaagcgcggcaagcgggaatcaaggctccaatcgttggtagtgacgggatggcggatgataaattagcccaaattgctggcaagtctaatgctaccaatgtttattacacgacgccattttctactaaggcttcggcaacgaacaaagttgcttcgaaatttatgagtgcttacaaggcaaagtatggtagtaccgcaccaactttttcagcactcgcttatgattcggtttatatgatcaaagcagccatcgaaaaggaaggctcggctaattctgttaaaatcgccgatggtttagccaaacttaagaacttcaagggtgtcactgggacgacgactatcgataagcaacataatcctgaaaagacgatttcaattgaacaattgacgaatggcgtggtcagcaaggtttataacgtcaaatagtcagactagtgaaagcgtgggggaacacatatgcagacatttggacaacaattgatcaacggactatcgctaggaagtatctacgcgttactggcgctaggctacacgatggtttatggcattatcaaattaattaattttgcacatggcgatatttatatgttgggggccttttggggctattacagtttgaagtcactacactttaactttgttgcggcgctcctgtccgcaatggtgatctgcgcagttagtggtgtgattattgaatatttcgcgtaccgcccattacgccattcaccgcgaattaccgcgctaatcacggcaatcggtgtttcattcttgcttgagaatggaatgtcatactttgttggtgcgagtgcccgttcatttccccaagcaatcaaagtggtgacttatcactggggcggattgcgggtatcgaatgtgcagctactgatcttaggaacggcgtgcctattaatgattctattggaattaattatcaaacgtaccaaaatgggtaaagcaatgcgggccgtttctgttgatcccgaagctgcacagttggtgggcatcaatcttaaccatacgatttcgttcacgttcgcattagggtctgcaatggccggcgctgccggagtcttgattggcctatactataattcgattgatccgttgatgggcatgacgcccggtatcaaggcctttgtcgcagccgtgattggtgggattggttctgtgcctggggcttcattggggggctttattatcggcatcctggagactggtgttcaggcgattggcctatccgcatacaaggacgcggtggtttactttgtcttaattgttattttgctcgtgttgccggctggaatattcggtaaacgaaccaaggaaaaagtctgagggaggcgccaaattaatgaaagcaaatttgaaaactaacatggcgtggctcggtgtgatggttatcggctttgttgtgattgacggtttagagctgataggcgtcattaactcgtttattgaaaatatgctggtgacgattggtatcaacgttatattggcggtgggactcaatctgattattgggtttgcaggccagttctcgcttggtcacgccggctttatggcaattggcgcctacgcgactggtattatgacccaaacaatggcgacgcccgcgggattttatctgtcgatgatcgtcggcatggtgattgccatggtagcggcggtcattgttggcatcccaacattacgattgcgcggtgattacttagccattgcgacgatgggggcggccgaaatcattcggattctaatcaataatctgaaaattacgaacggtgcagcggggttattcaatatcccggcacttgcttcgtgggcaacggtgtacgtcttaatgtgtctgacaacgattatcacggtcaactttattcacagtcgcggtggtcgggccgtgatggctgtgcgggatgatgaactggcggctggtgccatgggaatcaatacgacgcgctggaagttggccgctttcgtctttggcgcggcgactgcggcgattggtgggtcgttgcacgcggcctacattcagacgattgcgccgggtgattttaatatcatggcttccattgcgattctgattattgtcgtactcggtggggtcggcagtattaccgggactttcgtagccgcaatcgtattaggagcgctcgacacgatcttacaaaacttcggtacgatccgaatgattatttattcattggcactgattttgattatgatttttaagccagccggactgttaggaacgtgggagttctcattcacgcgtctattcagacggcgatcaactaaggaggcagttaaccatgagtagccggttattagacgcacaagggttggtcaaaaactttggcggcctgaccgccgttgctgacgtttcactccattttgatcaagacgagctgattggtttgattggcccgaatggtgctggtaaaaccacgttattcaacttgttgactggtgaaacgccggttagttcgggtagcattagtttctacacagatcagggcgtggtgtcgttaaatggcaagcagcccgctgcgattgctcgggttggtatttcacggacatttcagaatatccggttgttcaaggagatgagtgtactcgataacgtgcgcattgcaatgaccaatcattatcatgaacggtttttgactagcatcctgcgcttacctaagtattaccagactgagcgggcaatgacccaggcggcgcaagccttattagcgatgtttgatttgaccgccgtcgctgatcagcccgcaaagagtttaccatatggtattcagcggcgattagagattgtgcgggccctggcgacgaagcccaagttactcttccttgatgaacccgcagcgggtatgaatcccgaagaaacggcggatttgacgcgcttgattcgccgaattcaacaagaatttcatattaccgttgtgctaattgaacacgacatgtcactagttatgaacgtagtcgagcggctctacgtgttggagcacggggcgttactggcaactgggacgccaaaagccattcaacatgatccggccgttatcaaggcctatctaggaggggtgtaaatgcttaaagtacgtgatatagtcgttaattacggcgcgattcaggcagtcaaaggtgttagttttgacgtgcaacagggtgaaatcgttacgttgattggtgctaacggcgccgggaaatctacgttgttgcacacgatatctggcttgatgcgtccggtcagtggttctattcactatttggatcaacccatccaaaagacggccgctcctaaaattgtgcgggcgggtatctcgcaagttcctgaaggacgccatatttttcccggcctgtctgttcaagaaaatctacaaatgggtgcttttttacggcaggatcggggtcaattggctcagacttatcagcaagtttacgactactttccaattttgaagaaacgtcggcatcaagatgccgcgacgctctcaggtggtgaacaacaaatgttggcgatgggccgcgcactgatggcgcagcccaagctgatgttgcttgacgaaccttcaatgggattagcgcccatctttattaatgagatctttgagatcatcaaggcaatcaatcaggctggaacgacggttttactaattgaacaaaatgccaatcaagccctgaaaatcgctgaccgcggctatgtcttagctagtggacaagtcaagcttagtggtcggggttccgaattattagctaattcagaagttcagaaagcttatctagggggttaagtatgagtgttgcagattatatgacaccacgcctggtcgttgttagtcctaaaacgacgatcagtgtggcggtcgaattaatgaagaaaaatgcgattcatcggttacctgtcatggcaggtaatcgaatggtcggcttgatcacgcatggtatcattcagcgtgcgatgccatcacaggccacgagtttgtcggtgtatgaattaaattacttacttactaagacgacggtggatcaaatcatggaaacggcggttcaaactgtcgcagcaaccgctcagttagaaacagcgattgcaacgatgcggaaaaataagatcggcgtactaccagtcatgacgggcgaccaagttgtgggcatcattactaataatgatatcttggatgcgttcttaaatattgctggttacggccagccgggaatcgtaactcgggtggtggtccatcatgaccatgtcggcgtaatttttgccatcggaaaggtcttaacagaacacgatttaagtattcagacgttaatggtcgtaaatcaccaggctgaaaaagtgattgagctccacgtgaatagtgaacaggccgccgatgttaaccaagtcttgacagcagcaggttttgaagtacaaccggtcagtgattagctctggcggctattgtctattattggagattaggtggctaaagacatcgcgttgtacaaagttatagggcgtggtgaaagtgtgtgggcacaaaaaagattcaggatgattcaatcctgagtcttttttttgtcgtattgttacttaagactgcggttgactgaatgttttatagacaggacattcgctagctgatgggaaattacggcaactaactagtacttgtgaggagtagtgataactgattgagttcgttattaccatgcggttttgagcggtacacacaaatttaagaccggataataaaattgatagcaaaccgagactgatcaagaagaacgagactgacctgaacgtgacaataaaaaaaattattattaattggatcaaatccctatctgttgttttattaatgttgtacaagtattagaaaaacagcggatagaacgttttttaatgcaaaaatgatgaaacaaaaaattaatgccgcatacaaaatacggccggaacagttgacctggttgattttcacgagttaacaaagaagcaactcaaagattaaggggttgtaattgttggaaagtgtggtaaattattagtgcagttaatgaattaggcaaactaaaggggatgcacgatatgaaaaaagtagtaggcagtttactcatgaccagtaccattttattgggggccttaacgccaatcgttggtcacgcggccgatggtgaaaatcggagtgggacgacgaatgcaacggcaacgtttacggcaaataccactaatccagttgatccggtcgatccgactgacccaacgaaaccacttgaccctaagcctggtgatggcgataacggtgccaattccggtgctggtttgtcactgatctatgcgcccggtaaacttgatttcggttcacatgaaattgacgtgatcaataaccaaagctataaagcattaacaggtagcgatggtagcacggtcaccatggggtcaacgagtaaagttggtttacaagtctctgatcaacgcgggacgaatgcgggttggacattgagtgttgccgctgcggatggcacggatggtaacttaagtacgcttaagggggccacggtctccttacctgcagggacggtcatttcttccggatcggaagctagcaacggcagtaccggtggtaatggtgcggtcggacaagctgttgaacttgacttaggtagtcaagcttcgactagtgccggggcgtcctttacggggacaacttctgggaatgttatgacagcagcggataagagtggggcggggattacgtcggacttgcttgatccggctgcagtcaagttgaacgtcgtggctaacacggcggccgctacgacttacaagggcgtcctaaattggacattaacatcatcagcagataattaaattaatgaacttggagatgaccacgtaatagtgggcgtctcttttacataataatcgacggggggacgcaataatgaagaaaatgatgcggtggttaggggccatcttagtgatgatcagcggcttgtccgcggtggttccagcacaggcagccaatacggacaccagtaataatattggttttagtgtcgcggcccaaacgccgaaaaaccaaattgataaacaggcaacgttttttgacctcaaaatgacggcagggcagacccaaacgttgcagacgcgaatctataatacgactaaccgggatatccgcgttgcaatggggattcatacggcatataccaacagtggcggcgcaattgaatacgtgaccccggcgaaaaagtatgatgcctcactgcagtatcgggtcgaccaattgactaaaatcaaggggccaacgacggtgacagttccagccaacggttctaagctggtcagtgcccaaacgaccatgccgactaaggattttaacggtgccctgttaggtggttggtattttaaacgcgtcgatcaaaaggtcactggtgaagtgaagggtgctacgaatattagcagtgaatattcttatgtggtgggcatcaagtacagcttagggactgcgcccacgcccgtcttgaaactaagcgatgtcgctgctggaatggttaattatcaccggagtatcgtggtgacgttacgcaatactgcagcagtgatgataccacgggttaccatgaagacgacggtcacagccaaagatagtggcaaaaccgtcgtaaaggcgaccaaacaaggcgtgatgttggcgcctaatacgacgtttaattacccattgttactcaacaaacagaagcttcaagcggggacgtatcatttacacttggttgcgcacaatagcgctcataagtggacttttgaccgcgatttcaagattagtgctgccacggctaagacgtataaccaggatacggttgatgataacggcatcagtatctggtggttgattggtctgggcgcactgggcatgttgattgtagtcttactgattttgtggttagtgcttttcttgaagaagcggcggcaatcccaagactaacagcaatcggctcggtgtttagtttggggccgctaagcgtcatgaacaattagtagctgggcaaaaaagggggactgacaaatgatgcgatggctgttgatacggggcttactgggcttattaatcggcctaggaccatccatcgggggagctgctcagacggtgggcacttcgtcgacacaaatacagttctatacgtcacgttcagcggacaaacaagcgcctacgacggtgcaacaaattccgcagggcgacgttgtgtacgcaacgaaggctgtcaaagccgcgcccaatcgctttgtcggtcagtggcaacaggtactagcaacgggccgtttgccccaaaccggggtccaagcgaatcactattatcagtggctcgggttcctgaccttaatggcactcttattagggtggcaggtgcttaagttaatgcgtgaaaggggggcgaacacgtgaaacgactgcggcatattaagctaggcatgctgttactgagctgcttagcgtttatcagcatgctagcgattacgagtcaggcagcggcgcccgtgacgtctgcgacaacgacaatcgctaattcgagtaataagtactacacttactttaatagcggtgatgtcgttgggttcaatatctcgggtggaattgggatatatccaagcttaaccaaagtgacggccaactatgcggatcagggacgtatatcgactaagactaccacaataacgttgacctttagtggttcgttgtttgcgaatagttcggagattaaaacgctatattacgatgtcttttataagcaagcaaccgaagaatttggaacttcactagtgaccaagactccgacaaatatggcgactggttctagtacggtatcgatgaatactagcaagactttgacagtcgatatgagtaagttaaaggataatttgccagtatatattgggtttcgattaactacagtaaagggtgagacatccacgtaccgcttggcagtgtttaatcggattagccttaatacgacgctgaatacgccaacaacgacggataccactctgacaggaactgggattgccggtaataccgtcagcacgacaattaatggtaagtcgtacacggcgacaatcggtagtgatggtaaatatgaaattaagttaaatgatggcctcagtggggtcacttcagtcacagtaacgcagacgggagaagccgattatggcgaatctgaatcggtgactaaggacgtgacgataccaccgctgacaatcaaaagtagcagcacagcggtgaatttgtccgtgagtgatctagcggcgttaacgtctgatagcgatgctgttaattggttagttaagcaggctggcgtggttgcgacgaatcctagtaatgctaatgatacgatgacttatcatgcgagtgagagcggtctggtcgcgttattcaaggggctcgctgataatcagagtactgcggttcacatttatgcaacgagcgctagcggcttaacgtctgataaaattgcgctacaagtgactaagttagcagggacgctgtcgtttggtcaattaacgaccaatatgagcttcggcgatttaaaggtgccgttgacaccacaagtctatcaaccgactaatccactagccatcagtgtgactgatacccgggcgaccggggctaagtggtatttgtacgttagtgccacgccgctgacatcgacaacggtcagtggacggacgttgaagggcgatttggtttaccgtgatggtagtgcacagaccgtcttaacgaatcaagcgacgttggtccaacagggacaaaaagtcgcggggacgaccgatacggtagtcactgatgattggtcgacaacgaagggaatcggattatcagcgcaaccaggtatttacgctgatacttatcaaggtaccttgagttggactctgagtgatacgccagataaataagttagcgtgtatcagttgggtgacggggactttgaccagttacacttgaattttttactggttcgcagttgacaagttaggtgtcgtcatggtttactattagctataaattgaaacggaggatgactaatatgtcattagcaactaaccttcaattaaataatcaatttgcctttagctttttctttagatagcgtttgtattcgtttgatggatacaagcgcacgcaacgcgtttgtatctatcgagagctaaagttattcaacatgacttaaacgccaggtagatgcagggacaatctatctggaaaaatatcgggcccgataaaacaccagttagattcttcccagaatctaactggtgttttttgttttcagtccggttcatcaagacgttgatgaacgttgggcgaaccagacaatttttaaggagcgtttcaagatgaaaaaaacaactttaggggtattaattttaggtgctgggttactattagctggttgtggcaaacaagcaacgagtggtcagcaaagcgtgtcggtgggcatcttacaggtggttcaacatggttcactagaccaagcgcgcaaggggttcaaagccggattacaaaaagaattaaaagcgcataacagtaaagtaacggtcaagtatcactatctaaatgcacagggtgatcagagtaatttgaatacaatgagccaacaactcgtccaacagaaaaatgatttgttagttggcatcgcaacgccagctgctcaggcattagccaagaaaacgacgacggtgccgaccttggttacggccgtaactgatttgaaagcggcgggattggtgaaaagtgatacgaagccccaaactaatgtgagcggcacgagcgatttaatgcccgtcggcaaacaattacagttattgaagaatatgagtacaggtaataaaccgttggggattatgtataactcgtcagaagaaaattcagtgctacaagtcaagttggcgaaggcttacgcgaaaaagcacggtatcaacttaaaggtcgttagcgcaacgagtactaatgacgttgccagtgttttggccggtttgacgggtaagatatctggcctctacttaccaaccgataatttgatggcgagtgcgatgaagacgattggtcagaagaccaaggctgcaaagctaccagtggtaacgggttcgattgaaatggctgaagatggcgggactgcgacgtatggtcttaactattacgaattaggtgaacagactggaaaaatggcttaccaagtcttaatcaagaagcagaagccgcaaacaatggcggttcaaacagctgacaagttacacctctacgtcaataaagcgaatgctaaggcaatcggcttacaaccaagtacaatcaagcaaccataagaggggagcgaggtaatatgttaatcacgagtattggacaaggtttattatgggcgccactggttatcggggtgttcctcactttcagaattttaaacatccctgatttgaccaccgagggtagttttccattaggggctgccgtgacgattagtagcatgttggccggacagtcagctatcgtggcgagtttattaggatttgtcgccggatgtttggccggttgggtcacgggggtattagatactaagcttaaaatgccgtcattattggccggaattctgacgatgacgggactatattccatcaacatgcacattatgggcaaagcgaatattcccttgcttgaccagaaaacgttgatgggatggttaccagcgagctggtctttgaatttacaaaccatcgtgattgggtctgtggttacgctggtcgtcctggccgggttgatttggttattccagacgcgtttgggactatctttgatggcaacgggtaataatcctgcgatgagtgctgcgaatggaatctataccgatcggatggtcattattggctatatgttatctaacggtttgattgctttatcgggtggtctgattgcacagagtaacggttacgcggatattgggatgggaattgggacgattgtcatcgggctggcttcagtcctggttggtgaaatcttcttacatggtcgtcaaatctgggtccgtttgactggaatggtcgtgggcgccattatctatcgttatttgttgactttggcaatgggcttaggtttccccgtcaatgacttaaagattttatcagcggcgattcttgtcatcgtcatctgcttgccactattacaaaataaataccggacaaaacggcagttacgccggtaccttaaagagattggagtcgatcaacatgccacaaccaactattctgaacgtccaacacttgcaaaaagtcttctttcccggaaccagcaacgagcggcacgtcttaaaggacgtgaatctaacgattgaacctggcgaatttgtggcggttattgggaacaacggcgccggcaagtcgaccttgctcaatacgattgcaggaacgttaaatacggatgctggagagattacactagccaatcatcgtgtgaccaatcgtcccgttgcgtatcggtcacggtgggtggcccgggtgttccaagatcctaagttgggtaccgctggcgaactaagtgtggcccagaatctcacgttagcccaacgtcatacggggagcttgagtctgcgccgttatcgccaacgtggacaggaagaacgatatttaaggttgctggctagtcttaatatggggttagaagcgcgactgaatacgcaagtgaagtatttatccggggggcaacggcaagccttatccttactgatggccaccttgagccaaccagagctgttgttgctagatgagcatacggcggcgcttgacccgaagacgagtgcggaagtgatggcgctgacccaacaaatcgtgacggccaatcatctgacaacgatgatgattacgcataagatgagcgatgcgttgacatacggcgaccggctagtgatggtacaggatggtcagatcaagttggacgtgtgtggtgccgaaaagcaagcattgcggacggatgacttggtgacgatgttcgcagctgaggtgtgaggctgtcgttgcaaaaaacgacttgcaacggccgatgatcagttagcaggtcattatcttacttaacgaatttcgcaatcaaataaatgatcagtcctaaactgatgagaccaccgatgatagatataatgaaaattaaatcgccaaaatacattggttttcctttctagcttagcgcatgctgagcaataccaaaatataattattgtaggttcggttagtcaccgcttcgtgcaaatcatgattaagacgtgctgttagtttagattgcagttcatcaacacgtgttcgtccgacttccgaggctaggtgacaatcgttttagcataccatattagtttcgtggcgataatattcatatgacgtataattctggaaaataagttaattgaataatccataattgccggtaaacgttgctaaatggcgaatgagttacgttaaggaaaatttaaagaattgtccggcgactagattatcgaaaatagccctctgcgtatcaaatacgtagggggctattcatataattggcacatgtaacaagttatttcgtcgtgaccaacataatctcatcactgactttgacttggttggtcaacatcttgaatttcatcaaattgacagcatccatgttagtgatgataaccatcatggttgtggccttaccagcagccttaatcgctgccaggtcagctttggcaactacttcgccatggtgaacgggttgaccggtttggactagtacttcaaagggagcaccgttcaactcaacggtatcaatacccatatgcagcagaatttctaaccctgaatcggttttaaaaccgattgcatgcttggtaggaaagacggtgctgaccgtcccgtcgaccggcgccgtaatcgtcccgtctgcgggatcaattgcgaagccatcgcccagcatcttcttagcaaatgtgtcgtcgtcgacgttttcaatatctacgtactgaccgttagcgacgctgtaaaagtcggtggtcacaccactagtgatattagtcgcagttggtgctgtcgcaacagcttcattgctagtcgtggtcttagtaatgggtgcgttcgtgagctttaagtggctcaacgcgtcggcgacgaattggacttcggtcccaataatgatttgtagattatgatcgtctaatttgttaataccagcagcaccactgtgtttgatagcggcttcattaatggttgacgtatcggctaattgcaatcggagacgggtcgtgcagttatcgacaaccgttaaattatcggcaccaccgagcgcagcgtaaatttgcttggcttgacgtgtgtatttgtcatcatccgcatcagtggcgatggctaaatcatcggcgtcatcggctgtcactggttcgcggcccggtgtcatcaaatggaacttcttgattgcgaagtcaaagccaaagtagtaaatgacggctagaaccaatccttgtaagattaacattaaaggttgattagcaatcgggtttttaaggcttaaaatgtagtcaactaacccggcggagaaggcaaaaccggctgtccagtgcatgaaggcagcaaaggctagcgataaaccagtgaagattgcgtgtaaaacatagagtggccaagctacgaacataaatgagaactctaatggttcggtcacaccggtaaagaaggacgcaaacgcaccggccatcatcagggatgctgtttcaactttacgttctggtaacgcattgcggtaaatcgcgtaggccccagctggtaaaccaaacatcatgactgggaagaaaccagcttggtacatcccagtcacacccttgatccccttgtgtgctaagaatttaccaatatcattgatgccagcaacgtcaaaccagaaaacggagttgagtgcttggtgcaacccagttggaatcaataggcggttgaagaagccatagagaccggccccaacggcaccgagacccacgatgaatttgccaaaggtaactaatgcatcatagacgggcggccaaacaatgagaagcgcaacgctgactaataacatggtcagcgcggctaagattgggactagacgtttaccactgaaaaatgaaagagccatcggtagtttggtctcgtggaagcgattgtaaagagctgcggcaatcagaccagagatgatcccaatgaagacgttgccaatttgaccaaacgctggattaacagtggctaccttgatattcaagagtgtggcgaccgattctgattttaaaacgttagttggtaattcaaaggcaactaaaccagcaagagcggctgcgccatctttatcttttgacataccgagtgccaaaccaactgcaaatagtagtggtaattggctcagaacagcgttaccaccggcttgtaagaagtgtgcgacgatgtcgttactagcagatgcccaccagttaccaattcccacaagtaaagctgctgcgggtagaacggcaacgggtaattgcagtgaacggcccatacgttgcaaataattcttcatgtacaaaatccccctaaaaagatagttttgaataagtgcaatcattattgtacggtgctgaaagcgctattacaaccgctttttattggtatagtccattggtttaataagattaatagtacaattgggagtggtctaatataaatacaaatacggaactacaagtccgacaagcataagtaatactggtataaacgatgaccccaggtaatgagcataaaaaataaatattggtcggaataataggtgctaatgatagcgatttcaaaataattgtgaaaacaaatacaaaatcagttataataagattgattaatgaatttgttacttttaaaaaaggagttgtttaggatgccaacaaccatgacgactaatattaaaaataatgattttaaagacgtggtgtttaaccgccaatcagtacggcagtttgatccgactgtcaaaattgaccgtgaagaattgcaaacgattattgatgagacaatcagcgcaccatcagcatgcaacttgcaatcctggcattttgtggttgccgatagtgcggacggtaaggcaaaggcaaagtcggttttaatgccgtttaattatccacaaattgattcttgttcagccatgatttttgttctgggcgatacgcaatcgcatttggtctatcgggacgtgtggaataaagcttgtgaagaaggacgcattaccccggaaaagcgggatcaaatcttcaagacgttcttaccaatgtatgaaaatgcgagtccagaatttctacaagccgatgcgatgattgatagtagtatggccgcaatgcaattactattgattgcccgcgcacatggctatgatgctaatccaattgcgggttatgcggcagataaagtcgcgacgacctttggcttggatgccaagcgctatgtaccagtgatggctattgcacttggcaaggcagctagcgaaccaatcacgacaacgcgttacgctggcacgcaggttaccgaattcatttaattgagctaaccttttgatatctcaaaccttgatttaatagggcttgagatattttttgaacttttggttagaattttagttagtttttgttgtatttatctaactatcgtgctaacataagcatcattcaaatcaaggaggacaaaaattcatgacagttaataatcgtgatttatttagtagttttggaaagttgtttcagaatcgggccttcgtcatggcggttgcgcaacaatttcattttggcgaccatggttctgagcgtggcgggcgtggtcaaatgggcattttacgggtattggcggatgcacccgctggtttaaccaatgctgagattgctgagatcttagatattcggccgagttcagtcagcgccacattgaaccgtttggaagatggcggcttgatcgaacgtgaacctagtgctcatgacaaacgcgtggtcatcgtgcggttaagtgaccgtggtcgtgagatggcggaccatcgcgcgcaaggaacgagtgatctggcggatcagttatttggtaatctgacggatgatgagcgcgatcagttacaacatttattagataagttgcgggccaatgcggatgacatcgatattcaagatttaatgcaatttggtcaacaacacggttttggcccacgtcccggttggggtcatgggcatcattggtttaattaaattttagaaacacgaggcataagagcagatggaacgaccacaagcagcatactcgcgtctagcgggtggtaaatttgatttaaaacaattcttacaattgattcggcacgctagccctcgttattggcaactctggttgggcttggcattaggcttattggcgactggtgcgcagttgatggtgcccaaatttgcccaaacgttgattaatgggtttagtcacggcgttaatcagaccttactaattggtgtgattggcttattcttgatcagtgcagtcattagcgcgttatcaggttccttattggggatttttggtgaaaatgttgtcgctaatttacgggggactttatggcataaattagtccggctcccggttcgctactttgacaacgttaagacgggtgagatgacgtcgcggttggtgaatgattcgacgcagatcaaagacttgctcgctaacgcatttccgcaagtcgtgacgtcactgatgcaattggttggggccatcgcaatcatggtcttaatggactggcgaatgaccttgattatggtcttggcgattccagttgttttattagtcatgtttccaatcatgcggcagacgggtaagattggtcatgaacgccaagatgctttagctaattttagcgggacggcagaagaaacgctgagtgagattcgcttagtgaaatcgtccaatgctgaaccagtggaaacaacgactggtgcacatcagattaagacgttgtatcgaattggactacgcgaagccatttatgattccatctcaagtccagtgatgacggcaacgatgatggcgttattcgttggggtactattgtatgcgtctgcgcgggttgccagtggaacgatgacgatggggactttggtctcatttttaatgtatctgttccaaatcattggcccagctgggatgcttggtcagttcttcaccacgttagcaaaggccagtggctcgacggcccggattcgggagttgttgaatgaaccagaagaacaattgacggttggtgttgaacacgcagtcgccaatgagactttggagatgcaccatgttgactttgcctatgatgatgatcaacaaattttacacgatatcagttttgaagctaaaccaaatacagtggtggcgtttgcgggaccgtctggtggtggtaagtcgactatctttggccttctggaacgttattatcaaccaactgctggtgaaattagtattggcgggcaagatgttaatgaactaagtctcaatagttggcggtcacaaatcgggtatgtcagtcaggactcggcaatcatggccggtacgattcgtcaaaacttaacgtacggtgctgatcggttatactctgacaatgagttgtggcacgtcttagaattagcttccgcggctgactttgtacgcgccatggcagatggccttgagacgcaagttggcgaacgtggggttaaagtcagtggtggtcaacggcaacggttagccattgcccgggcttttctacgagaccccaagattctaatgctcgatgaagcgaccgctagtttggactctgaatcagaagcgatggtccaacaagccctcggcgaattaatgaagggccggacgaccctagtgatcgcccaccggctgagcacaatcgtggatgcggatcagatttacttcattgaagatgggcatgtgagtggttcaggtacgcatcaagagctgatggcgaacgtcccactctatcgggattacgttaaaattcaatttaaagattaactaaaaatagttggttaccatgacgtgggcacgtggcaatcaactgtttttgttgtctagtatcggtcagaaaagcataatttgatgaaatatgtcgggatggattgttattataaaagaatatacattttatatattaagcgctatcattgttatgataactagtttaattgataaaggaatgataaaacgatgcagtcattaggagttattgatattggtggaacgaccattaagtttgctgtgtggcaagatcagcaattagttgctaagaccaaagttacgacgcccacaacgctagctgaattttacactttgctaaccacgcaggtcgcgcagatgaaacgcgattatcaaattgctggtgtaggcattagttcgcccggggctgtcaacaaggcaactggaattattgagggtgccagcgcactgccgtatattcataattttaggattcagccggaattacaacgccgttttgaattaccggtcagtatggaaaatgacgccaattgtgcggcgttggctgaattggcggatggggctgggaaacaggttgctagcctgtgcttcttaattgtgggaaccggtgttggtgggtcggtcattgtgaatcatcaaatttggcacggtgcgcacttatttggtggtgagtttggattcacgctcatgaatgaccatcagatcttaagtgaggtaggtactgcggtagctgttgcgaagcggtacaacgcgagccatccagctcaacctgagctagacgggcaagccgtgtttgaactggctgccaagggtgatactgatgctcaagccgaagttcaagttatggttcgggccttagcgcgggccatctacaacttacaatacagctttgacccggaattgatcgtgatgggcggggcggtctcaaataatccgcacctactcccagcaatcaatgatgaaattgaaaaattgcgggcaacggtcaaaattgcttctataaaaccagatgttgtggcttgtcatttcaccgatgaagctaatttacggggagcggtcgttgacttttgtcagacgtatctggacattcaaaaataaaagtctgaaaagtcgatggcaagcaagttattcgcatttcaacgccaacttacttagaatagtcataataattataaattctaagtaaggaagtatggactgatggtaatgcgtgatctaaatattggcacgaaagtcgggttaggcgtcctcaatgaccggtgggccgcgttagtactgatcaacctgaaggcggcgccaactgagattatgaatttgcgccagcgagttaggggtcttagcacgcttaaactactgaatgttttagctaaattaaccgaattaggattagttgcgactgcagggaactatcaatttcagttgacgactgcgggcattagttttcaaaagcaactgcatcagttggaagtgtggggcgatcaaatgatcgtggccatgcactgaatataataagtattgactgtcgtgactaaaagctggtcgtaatccacaattatgggattatgaccagtttttagtttggtttctaattattatcggccccaagcggacgatcggaaaagagatggtaagctgcggtgtagcggctctgaacgataatgttggcaaccacttcaggtggctccggatgggccttggtcagccagtgctgaataattgccagcacgccactaaagtagattggcatggcgtagtcagccggaatcgactggaaatattgatgatttaagggcgcctgctcagtagtggcgagtaaattatcaatgagaccggcctgaaactgatcaagaaactgtggatcaccatgggggccaagcaaggcctgaaaactagctaattgggtgttgatattcgttgttaattccagataggttggataagcattccgcgggtcaggatgaaccaaggcagcttgaatcccttggttaaggacttgctttgaaacggttgcttgttcgattaaagcatgttcgaaagcgtgaatgaagtcgtaaatatcttgaaagtgactgtaaaaactcccacgactaacgtgggctgctttgacgaccatggtgacagtcaatttaaagatgggtgtcgctgtcagtagtgttgggacagttgcgaacattttctgtacggcaagcggatagttagttgtcatcatgtcacctcctgtaaatggtcaatttgacatcaattgtacatttccaacgcactcgtttggtcttagactatggttattctaaaaaacgaggtgcagctaatgtcaaaaattgattttcatacccactatttaccaacgagttacgttgaggcactaaagcgtcatgttccaggtgatcctgatggctggccgacacctgagtggacaccacagcttacgcttaactttatgcgtgataatgatattagttactcgattttatcgctatcatccccacacgtgaacttcggtgataaggcggaaaccatacgcttagttgaagcggctaacgacgatggtaaaagcttggcccagcaatatccagatcaattaggatacttggcgagtctaccaatcccttatgaactggatgctgtcaaaacggtgcaacaggctttggaccaggatggtgctttaggcgtcacagtgccaaccaactcacgcggactttactttggatcaccagtcttggaacgggtctaccaagaactagatgctcgccaagcgattgtggccttacatccaaatgaaccagcaatcttgcctaaaaacgttgatattgatttaccagtgccgttgttgggattttttatggataccacgatgacgtttattaatatgttgaagtatcacttctttgaaaaatatcctaatatcaaggtgattataccgcatgctggtgcttttttgggaattgttgatgatcgaatcgcacaatatgcgcagaaggtttatcaggtggatgtttatgatgtgatgcaccatgtttattttgacgtagctggagccgtgctaccacggcagttgccaactttaatgagcttggctcagcctgagcacctactttacgggagtgatattccatatacgccgttagatggctcgcggcaattaggtcacgctttaacaacgactgatctattaacaaatgagcagaaacaagcgatcttttacgataacgcccatcgcttactgactgagtaagtgatgttaggataactgttgaatttttggcgtgaccaatattaaaaaccggaacacctgttaattactggtgttccggcttttttacgttattgttagcataattagttgggctaatctgctgtacgggtaatgcaagtaatcagaaccctcgtctaaaaataaagtggctatggtgttgctgttttagccattgtctgaccgactgttgcggtatattcacgttcaccaagactgttgggatgtaaattatctttgacaaaccagttgtcgttgtcttgcgcaacgtatagccaatcaatgagatgcacattgttatattttttagcggccgcggcaatcaattgattgttagggtcttgccaatctttgcctggaacgcgggtgttgacccagtaaatctggtggttgctgccaatctgatcaatgatcccatcgatttcggcggcacttgttggaccgttcgtccccaagttgatcagcacgtttttctgaattgcattatcagcttttaattggctaatgacggctggtgcttccgacacttggcgaccaaccttggcgttaacgttaaaatggtcaaagatttgttttaagtcactcgtggtgcggaccatgattgaatcaccgatccccgtcactttaagtttgcgcaggacgtgaatttcactagtggataattgatatttttcaccaagggcactatccgaaacggcgtgtgtagcgcccttagttttagtattccccgtaatggcgttgccaatactgacaacctgttgcttaatggttggtgttggaatgattaatgcgccaccaatgaagacgacagcaaagattccgaccaaccaataaattaatttttgatgtttcatttggcacctccataccccgctataagattagcttaccaccattacagtgtcaattatgaaatttatcataaggtgcttaaagtggtgtgatggcaggtttgtcagtcggactgtctaagttgaatttgaaaagatcattggaaagtcaactggtgcttgttagactaaggctagtgcttttggaggtggttaaatgcaaaagaaaacggtgggactgttattagccagtgccgggccttttttgtggggaagctcgggaacggtggcgcaacatctatttgacaccacaacgatttcgccgttgtggttagtggcggtgcggatgctagtatctggaggtctgttaattttatatggatttagtcgccggttaccggtcatggccgtgtttcatgactggcgggcaacggtgcgtctgattgtgttcagcctgttcgggatggctggcgttcaattgacttattttatggcaatcagtactggtaatgcggcgatggccgcaattttgcaattcttgtcaccggtgatgattattatctttatcaccgccacgacttggcagcttccagggaaagtggatgtcatttctgtggtctccgcaatcgctgggacggttctaatcgtcacggaggggcacactgactcgctggctttgccagtaattgcaattatctggggattgttggccgcggttggtgcaaccatctacacattaatgccaacaaaattattaaaagtgtatggcgccacacccattgttggttggtcaatgctgattggtggtggcttggtgctagtcggaacaggtgcttggcaccattcgccacagctaacctgggtggcgtgggggcaagtcggcttcgtcgtgatttttggcacgatgctggcctacttgttctttttacagagcttggaatacatcctaccaacgactgctagtgttctgggagctattgaacccctagcagcaaccattttaagcgtcttatttttgcacgttcactttaactgggtcggactgcttggggcgataatgattgtcggggtaactattttgcaatttgcagcggcacgcgccaatcagtttgtctctaagtgagcattgattggtatagatggggaccaaacaatatatgaacatattaatcgttttattcacaaattctattgaaaatccatcttgctagcgtatacttttcgatgaaggatattatgttacgagggggatttttttatgaagttaagtaagcggggactattctggctacttgggttagtaagttttgcaattttactactatttagtcagccactaggggcccaagccgcaactaattatcatgcgaaggattacacaactgccgcatcggtcatcaatggtcctgattttaagcacgctgataccattcaaattcagtatcaaatgagttttggggatacggctttcaaagctggggacacagtcactattgatatgccagctaatttggaaccacggaccgttggggctacttttgatgtgactgatgctgtgactggtactgtgattggtacgggtgtcgtcggcggggatggtcaggtcgtactgaccatgaattcggcgattgaaggtaaaactaatgtaaagattgatgttaacctgggaatgaagtaccgttatgatgacttaggggaacaagacgttgtgtttgatacccaagacggtcaagatacatcagtgatcaatatggttgctaatgaagctaatatgtctaaaaaaggcaccattgataaagaaaatggcacgattaagtggaccttacttgttgatcggcgtgaaattaccatgaaaaacttatcgattgccgataccattggtgatcatcagcaaatgatcaaaggtattgaagtctacaatggtgaatggtcgagtgccaacacttacaagcggcgtgataagcttagtgacgatgcttatcaagttaactacagcgataatggttttgacttgaaattcaacgatacagtcagcaacctagttgtcatcgattactatactaaaattacggatacagaattaattgatcaaaattatcattttaaaaataaagctgtaatggaatggggcggcggtacgtccggtggcaagaacagcgaagaagctaacggtaaggtctacgaaaaagtcgttaacggtgggagcggtactggcgacttaagttccagctcgagttcgaacagttctagctcaaataattcgagcgacgtcgattccagttccgactattctagctcagaaagttcaagcgctgtggactccagttccgacgattctagctcaaataattcgagcgacgtcgattccagttccgaccattctagttcggaaagctcgagcgctgtggactccagttccgaccactctagttcggaaagttcaagcgctgtggactccagttccgaccattctagctcagaaagttcgagcgctgtggattccagttccgaccattctagttcggaaagttcgagcgctgtggactccagttccgaccactctagttcggaaagttcgagcgctgtggactccagttccgaccactccggttctgaaagctcgagtgatgtaaatactagttctgagagttctgacaatacgactacggaaccagacaatggccatcagactggtgacattgaagatcccgaagataatacggcggtttatccagatatcgatgaagatactgggaccatcgatgttgatggtgggttcgatagtaactacgatgggagtacgacttccaacagtactaattcgtcaaaaccattgaaagattcaacttcgagtgtctttacgagtacgcccgctaacacaacgacgggccaagatggtgctgatcaaacgccagcagcggatactaaaaagtctagtgctaagacaacggtatctgaaagtgacgcgttgaccccatcaacgcctaaccaagttgctaaattgccacaaactaacgaagctaagatggacagtcaagcgcttcgttcagtcggcattttgttaggtgtattaacgctaggtggcggtgcacttatccgtcattggttttaagtctaactgatagccctaaaatgatgcacatataatgttattttttaaaacggccttctgttaattcagaaagccgtttttagttagcggtcatttaatagctaacttgaaatagttagattagttagcaatggcgaccatggtcgttagaagggctcactggttaacgcacggcaacattagtttacgacgggttcacaagcggctgctgactacgttaatcgttattagtcgcaattggcataactggttgcgcaattcgatttgattttaactggataatgggggtaaagtaacgaatagatagaaatggaggtcacaagatgagtaaccgattgatttttgatgctgactggctggtgccggaacaggtccaagttgccgggcaggctattcaatattatgctgcccgtaatattcagtacgttcagcatccagtcgcagcgattcaggtcctaaacgtttttgtaccagccgcatacttgcatggcagttcagtcaatggttatcagcgggcaacggcgccaattctgatgccgaatacggtcggcggttatttgccaggaccggcggatgatccgcaacgtgtcacttggccgacgaatgcagggacgattcaacaggcacttaaacgcggttacgttgtggtggccgctggaattcgcggtcgtacgacggttgataagtctgggcaacgggtcgggcaagcgccggcttttatcgtagatatgaaggcggcaatccgttacgttaagtataatcagggccggctgccaggtgacgcgaaccggatcatcacgaatggaacgagtgctgggggtgccacttcggctttagcgggtgcgagtggcaattcggcttattttgaaccagccttaactgcgctcggggcagcaccggcgactgacgatatctttgcggtgtcagcttactgcccgattcataatctggaacacgcagacatggcctacgagtggcagtttaatggtattaatgactggcaccgttatcagcctgttgcggggacgaccaagaatgggcgaccaaaatttgaaccggttagtggtcagctcacagttgaagaacaggccctttcgttggcgttaaaagcccagttcagtacctacttgaaccagttgaaactcacggccagtgacgggacgcacttgacgcttaatgaggcgggaatgggttcatttcgtgatgttgttcgccaattattgatctcatctgctcagacggcattcgatcaagggacggatattcataagtacgcaggctttgtcgttactggaaatcaggtgacggacttggatttatcagcttatttgaagtcgttaactcgcatgaaagccgtcccgacgtttgaccaattagatttgacgagtccagagaataatttgtttggcgatgcaacggtgcaagccaagcactttacggccttggcacagacgcgaagtacggtgacggcacaactagcggacgctgagctgattcaggcgattaatccgctcagttacttaacgacaacttcgtcacaagttgctaagcactggcggattcgccatggtgcgaccgaccgagatacgagttttgcaatcccaattattttagcaataatgttagaaaatcatggttatggcattgattttgcgctaccgtgggatattccccacagtggtgactatgatttaggcgatttattttcctggattgatggcttgtgccaatgatttgaatacgatgagtgaaagcgaccagcgagggcatcgtgcctggctggtcttttcgtttagttggcaacgataatgtgatgaaaatacgttgacaattttcaaaacacgtggttaaatgtagctattctcatttttatctaatcgtattcttattaatttaaatggaggcctacatatggaagcaactacgaccgcggctaccgcgacacataagatgagtaccatggattacgtttataaagtttcagcaggtgtttctaatgctattttagtttgtttagggattggattgttattgcagtcactcgcgaattttgttcactgggcggcattataccaagtcggtgcgattgcgcaagtgttattgggaccggcatttggagtcgcgattgccacgatgctcaacagcaacacgttagttacgtttagcgccatgatttcgtcgacgatcggggcgaacgccgtctttttctcgcagtccgcaactaacggcgtcacagcgacggggcatacgttggcccaagcagctcagagctcgatctttaccaccggtcaaccgatttcggccgttgcggctgggttagtcgcggttctgatcggtaattatttaactggtaagacgccgcttgatatgatgttggtcccgttagcggccacttttgtcggtgcggtggttggtctcgggttagcagccgtaacgacgcccgcattggtctggctgagcaagttcatcgcgacttcgatgaaggtcaacccattgatcggttcgatggccgtttcacttgcctgggcgttatttttaatgacacctgcgtcttcggccgcattggcggtggcggtcatgttagatcccgtctcatcgggcgcggccttaattggaacaaccgcccagttcgtgggctttacgattatgtcttttcgccaaaacaacttgggggccaatatcgcgcaggggattatcacgcctaaagtccaatttccaaacttgctggtgaatccacggttagcgattccaccaatggttgctgcggttattgccgccccggtagcgacgattgcctttcatttttcaaccagttacaagctggccggcttaggattgaattcgttaattgcaccgatttcgttagcatcgacgaactttaacagttttgtggtctatctcttgactggggtgctgatgccagcagttatttcaatcgtgctgtaccgcattctagttgcggcaaagtgggtcgaatcgcagcagctacagttggaaatcgtttgatgtccagccgatattaagagcctgtttctatgactgatgtgaaggccatggaaacaggttttttgtatagtgttagctgtttgttcaggatagggtgagtaggactatgaaatgggacgtaaatccactatattaaaggtgtgaataatgaataagtgagatgacatcgatggaatttaagattaaacgggatgggttggcgttacaggcaaggttggagactccggcggcaccgagctcaacgctagtcatcttaatgcatgggtttacggccgatatgggatatgatacgacccaatttgtgccgcaattggcgcaggcattagttgctcacggcttggcagttctgcgttttgacttcaatggtcatggccgtagtgaaggtcggtttcaagatatgacagtgattaatgagattgcggacgctaaagcagttttagatgaagcgttgaccttacattatgaccacattgtcttggcagggcattcgcaaggcggggtggtagccagcatgttagcaggatattatccagacgtggtcgacaaactgatcttgatggcgccggccgcaacgttaaagtccgatgcgcaacaaggtgttctgcaaggtgcgacctatgatccacaacatattccggcctatttgaatattcgtgatggccttaaagttggtggcttttatttgcggaccgcgcaacagttgccgatttatgaggtagctcagcagtattccggttcggtgacattgattcacggtacggccgacacggtggtctcgccacaggcttctgaaaagtatcatgagggtctatcagcacagtcagttgcattgggttcaggacggtgaccatcgctttagcggcgatgtgcgcgctaccgcgatccaattagcactggccgcgtttaaatgatgacttacgccagttaatataatgttaggttagttaacgttggtgagtttaaaggcggtgctgacaaattagtttaatgttcaatgaaaataaccttaatcttttaccggaagacgcctatactaagagtagttagttttctgaaagtaaggtgtgcaacgtgaaaagtgaagtacagggaatcattcaagatttatatcaagaattagcaccaactgcggcgaatcaagaaattcgggcagcactattgaaggcacaccaacaattgaaacaggcgccccagcttgatcatgcgctaattaagcggttaacgaatgacgtgacttataatatttttactaaacagttgcgcttgacgccaactgaaaacttattggttagtgagttactatcggtcagtcatcggttgagtgcgtaatggctgaaccagcgactcattttggaggtgggacgatgcgccgaatcatcgcaatcgggaaagcactagtgacggccggatggttaataacgattattctggtggtttacggtgttagccgtcagctcaagcggacactattcgagtagcaccctgttatcggttacaaattaatttgctcaatctaatgaatataaaaagcctcgtaaattaacgcattatcataagcgttaatttacgaggctttatttgtgataccttcgaacaactagtattgactaccgaacaagttaccaatttgattggcaaagtcagttacgtgactgagaagtgcagtctgtaaatcctgcagaataattttatccataaagtagaacagcaggctaacgactagaaccgcaataagggctaggtagacgcggctaattaatggttgggtcaccgacttgttaatgacgaagatcaaacctaattgccagacaaggacactgacactcaacaggataatcgaccatctgaagctagccgcaatggtaaagaagttatcaacactgaagttaactagggacgaagcaaaccataataataggttcacaataattgcgtaattggttaactgaccgaagcgtttcatataggtcgtaaagccgactttggtcccacgacttccaagtaagcaagtgacatagccgacagccaggtagaagcacatgccgattaggagacataagaaaatctttaagtcggtggaaaaagctaatttactaatgtggaaatagctttgactgtcattggcagtggtcagaaacttattgctaatggttacagcggccaacgtcatgaatagtgcttcaatgacaaaggaaatgtaactaaaataactttcagttcggacttcacagctaggatttttccagctagccaagagccaactaaaataattcttagcagatgattgcagctgttggacttgttggttagtagccgtccgtgtcgtatcagcagctgctactgaacgtgatgctgtttgtttttcagcgctggccgattgttgttgattggctgaagctgtgctggtatggacagctgcttgcgtcgttgcagtcgttgtttgggtagctgtggctgaagtggcgttggccgttgctgaggccggtgtcgctttggttagatcgtaaccacagtgggtacagaactttgcattggcagcaatctcagtgccgcagttgggacattttttcataagttaaattctccttcattaatcatcagaatcatcggatttagtgtacgaccgaattttttgggccggcgtgattttaacaatcttgtagtgccctccggttttctcgaccgtcgcggtgtaacgaaagacctgaatgcgttcatcttcagagttggtaaagtcatatttgacgtcataagtgatctggctttgttgtttagctgctggaaccgttgataagacagtcggctcataggtgacatcgaggacgtcatcattgtcgtagtagcccttcgccatttggaccagttctttgtagtccgtgttatcggtaccgttgacgaagtagtcgtccaaagtgcggtcatcgtaatccgaagcatccgataggtcaccggtggacgtataactgctgacagcggtgaagataccgttcaggtagtccgaggcagtatctttactcatcacaccggcaaatttgaggtccacgtcttgaccctcagcgtcactaacgttagtttgtttggcggtcaatgtttgtgaaccggctttgtatttaccagtcaacatcatgcgattagaccagggaatatcattcagcgccagtgtgccactgctgttaatcgttccttcattttcgccattgatataaacggtggtattcggtgtaccattaacggtgaaggaaattgtacgtaaatccaagtcgtaagtttggccgtttgcccggaggtaataggtgcccttattggtaatctgatggccgctaaccgttcccttggcagtcaaggtgtatgaaccaggaacatacggcccgattttatgctcgtaagttgctttattagatgttgcgacgtgcttaccattaacgctgagtgcaacgttacggtggttcgtcgccagtgtggcataaacagaagtgacttgtagttgatacttatcgaaaaacaaccaggatttaccggttttaacgaactgaataccgtaatcattagtcgcagaacgacttttaagcgaactagccagtgatgctaatgattttcgattgtttttaaagtaagtgaccatcggcttgacgctatcatttgtaatcttgagtgatgggtcagtgctagttacttgcttcgctaaaccttttccagtcttgagtgcggttaagtcacggtcgagctgattgagcggctgataataattctgtccatacagatagccgccaatcagaatgacaacgataacggcaatcagaccccaaccccaagttggcatatggcgttgggtttgttgtcgaaccttgcgcgtcgaacttgttgttgactgcgcggtgtttactgatggcgatggctgatcagtggttgcgtgcaacttaaaaccgcaattaggacaaaattcatccgttgcggccaccgcttgcccacagttaggacaaaacgatgcttggccgcgacgatcgtcagcggctttaaaaaattggtgctgtttatacattccccgatgctcctccaaaaatagattgattagtcgacaataaaaaactatttactggagtcttcacagtaaatagccgctactatcaattgagttaaaattctgaataagacgtgtcacttgaatatgaataataagtgctaatcgatgaataaggctattgatgactaatcatcgttaataacttaagaaagtctaaaaattattaacatattttaaagtataaacatgattaaactgtttatcaatgtttacacggcgtatttatttagtaatgccccagtttgcacaataaacgacatgtcacgcattaaaaatacgactcggctaaatgctgtgccgattcgttagtcatgaattatgattgaaacgtgctgatttccaaagtcaaaagcagccagcttaggcccgctggaaaaagttcgagttagcgtaaaattgcttagttggcgcgtcttacgccgacttccaggcatttctgccaattgctggaacgcggtggacacagatttaagccgcaacccacgtcttaaatactggtcttccactaaccaagccaaggacgcttgctaagtggaatttcaccgctgagcattggctgaaacgccttccagtcggaacagtgttcgaatggcggacatgtgcgtacccaacttttggtgaattcgtcattgtttttcataaacaataactttgtcaatcaactgtcagggtgaaaatgatattgagatagctcactaatcctgaattggtgtagtaagatttaagctcttgacagagggcttaatacacctaacgctttgtttaaagttccagtatcaaatagcgaacaacaaattgtaccgagttcggtggtcgttcattagccattcgagcgacttctcgaccggaggggctgggtggacaatgctcagtagccaaattattcttagtcggaagtggggtacttccggcttagaataagactcgtatttgagatgacgcgggttgggcgttagctcaaatcgacgtcggctacgttccagcaattgtcacccagccccggaggtcggaataggacgcgcaccggctgacgaataacaatctaaacttggcacgtttcaatcataattaatacataacaatcatcgacctaatgcgtttagttgtattattccattcacgaataacatatctgcgcaatccgaattgaacccgcttacgagtggccgtatgatggtcttgtaaactttaagggagatgaatgaaatggcagaacaaccatgggatttgcgtcgcgtgcttgatgagatcaaagatgatccgaagaactatcatgaaaccgacgttgaagttgatccaaatgcggaactttctggtgtttatcggtatatcggtgctggtgggaccgttcaacggccaacgcaagagggtccagcaatgatgtttaacaacgttaaggggtttcctgatacgcgggtcttgactggattgatggcgagtcgccggcgcgttggtaagatgttccaccacgattatcagacgttagggcaatacttgaacgaagcagtctctaatccagtggcgccggaaacggttgctgaagcggatgcgccagctcacgatgtcgtttataaagcgacggatgaaggctttgatattcggaagttagtggcagcaccaacgaatacgccccaagatgctggaccatatattacggtcggtgtggtgtttggctcaagcatggacaagtctaagagtgatgtgacgattcaccgaatggtccttgaagataaggataagttaggaatttatatcatgcctggcggtcggcacattggtgcgtttgcggaagagtatgagaaagctaacaagccaatgccaattacaattaatattggtttggatccagccattacgattggtgcaactttcgaaccaccgaccacgccattcggctataacgaattaggtgttgctggtgcgattcggaaccaagctgttcaattagttgacggggtgaccgtcgatgaaaaggcgattgcgcgttctgaatatacgcttgaggggtacattatgcctaacgaacgtattcaggaagatatcaatacgcatacgggtaaagcgatgcctgaattcccgggttatgatggtgacgctaatccagccttacaagtgattaaggtgacggcggtgacccatcgggagaatgccatcatgcaaagcgtgattggcccatccgaagaacacgtcagcatggcggggattccaactgaagctagtatcttacaattggttaaccgggccattcctggtaaagtgacgaatgtttataatccgccggctggtggtggtaagttgatgaccatcatgcagattcacaaggataatgaagcggatgaaggaattcaacggcaagcagctttgcttgcgttctcagcctttaaggaattgaagaccgttatcctggttgatgaagatgttgatatttttgatatgaatgatgtgatttggacgatgaatacccgtttccaagccgatcaggacttgatggtcttatcaggcatgcggaatcacccgttggatccatcggaacgtccacaatatgatccgaagtcgattcgtttccgtgggatgagttccaaactagtgattgatggtaccgtaccattcgatatgaaggaccaatttgaacgggcccaattcatgaaagtggcggactgggagaagtatttgaagtaacgtcatccattgcacttgatgagcgtattgttagtgcattgaaccaaaatttaatcttacaaagagccgccagaccaacggaagtgtgctggtcggggggctttttgctgtcaaaaatgaagggagcttgtagctcgtgaacaagaaaacgattggctttttcagcggaatcgccgtgtttgccattatttactttctgccgattgccggcttgtcagctaagggtcagatggacttggcacttagtttgatgacggtcgtctggtgggccacccaaatcgcgcaacccgcgttcgttggtgggatttacttaatgttgctcattattatgaacgtggcgacaccgtcacaggtcttctcgtcggcgtggaccggttcaattatgtggctcgtgattggggcgtacttgattgccggggcggttaatgaatccggtttgggtcaacgcatcgcgtatgcattcattattaagtttgtgcggagttggaaggggattgtgatttcgatttttgccctgacctttatcctcgcactcctgattccccatccatggccacgggcgttcatgattatgtccgtcattacggtggtcgcggaaacggcgaagatgcccagacgcgatttggctaagctaggcctcgctgtctttgctgcgtcctgtccactatccggggtcttttatactggtgacacgtcactaaatccgttggcagtacaggcctctggtcaaagcgtcaactttgtctcttactttatctacatgggcgtgcccatgatcattgcggccatcttaaccatgtttctgttcttattcctcttcaagcctagtcaggaagtccacatcgatgtggaagcgttaaagcaacaacaagcccagttgggtggtatgacggggaaggaagttcgaacaattatttggctgatcattgcgattgcactctggttaacgagtgggatcaccgggttggacgttggttggttgacattgatcgttgcgctgatgatgagtctcccagtagttggcgggatcttaacggccaaatcatgggaaggtgttcccgtgaacgtgctcgtgttcttgacttcggcaatcgcaatcgggaatgtcggtggtgtgactggcatgaataattggattgcgaagaccttgattccaagcaacttgccaactaatatttatttattagcgattgtgattactgtttttgccatgattatccatatgttcatgggttctgtcattgcggtgatggggattacgattccggccttcgtagcggccacggctcatatgggaatttcacccttggccgtatcgttactagtcttctcggtgacaaacttgcattatattttaccgttccacaacctcgctgtcttagttggaagcgaccccgatactggtgggggttacacacaaaaagacgtgatgcggttaggaatcccactgacggcggttgtctttgtcgttgcgttagttgagatgttctggttccacctcgttgggttggcataagcggataagtttaaaaaatacccttttcaaacggccggttggtcggatggaaagggtattttttaaacttgttgattttcctgggcagtcaccgtcaagtagtcaattaagtcggtgagtaactggttccccgttcgctggggatatacaaagttcagttgactgatgaacgggatggcgagtgagcgcatgaccacgtgttcagtcatgaacggaagtaccgattgtttaaataagaaagtcacgttattttgattgagaatgcccaggagcgtttcaatatgcgtactttcaaagaagaattggggcgtcatgccttgctgagcaaagagtgcgttgatcggttcgtaaacaccggagcccggtggtaacgttgcaattttctgccgcgctaagtcttgaatccgaatgactggctgggtagctagggggtgatcacgcggtaaaataattttgagttcgtcagcgagtagtggttgtttttgaaattcggtgggttgcaattgggtcgtctgagtatcgcgaatgatggccgcttgtagctcaccactcagtaaccgtttgacgatttggtcgccctcatcctcgatgattttgatttcagtatcagtatgctgagtatcaaaagtggcgatctttttggcaatgttatattgacctgagattggaatggcgccaatgatgagcttggcaaatgtcgttggccgattcggtgccaaatcgtgcatcatggtctcatagtctgtaatcattttatgcgcatgatgatagaacgtttcaccagctggcgtgatttgtagacggcgcttgttgtgtgtatctagtagtttaatgttcagttcgttctcaagggctcgcattcgtttggacaattccgattgtgataagtggagttctacggcagcgttagaaatgtggcgtaaatcgtacaccatcacgaatgcttggaggtcattaatggtcatagcagtcacacttttctttaggttaaattctattctaacaccgatggcggggcccacctaattaagtaacggtataaattagtatcaatattgtgaggccgctacggtaatcgaaatattagttattttttttattgagaatgggtcactaatgaaatcatggtgcgggttaacatttgttagcggtgatgattattcgttaccgtttaattgtggatggggactcgtgttgagggaggcagtaatgacatctagatataattattttggtgatgtggatgaaagttgttgagtggttggtgattacaaatacgctgaatcactagctttccttgcttttgaaattgaatccggcaaaatgaaatagttccagcagtttcatattgatcatcatgctggtcatggctgggcaatactttttaaaaggggattagtttagtatgtcaaaagcgtttaagatagtgatgggaatcaccatgttaacagggggcatcatggcccagaaaatgacggtacatgcagccgaatctaacactcgaaccggtcaggcagtaaggatgaatggcacggtcagtttagcaagtcaggtcgaaaataacccagctgttaaggcggctcactaccaggtaacacaagcggtgcaagcattaaccatggctactacggcagtcaaaacggctatgagtgatctgcaagtggcgcaaaccacgttagacgctgccaacaaaacgttagccaagaatcaaaagattcagacgcatatgggcgtacttaagcaagcagccactgaccggcacgtcaaggcaacgaaagcactagatgaacaattggcaactaaaaagacaagccaaactgcggtaacgacggcgcaagcggcagtgactaagtcacaagctgctgttcaagtagcccagagcaacttcgataaggataacagtgcggccaacaaagtcacgttacaaactactcaggcaaagctgaaaacggtgcaagagacgttaacagcggcacaagctaaccttgataagactaatgagcacgtgatgatggcagaagaagaattagccaacgccaaaattgaagtcagtggcacgagccgcgacttccaaatggcacaaagagattatgatattgttcagccccaagcagcagttaatcaggcgaaagcagcggtgacagctaagttgcagcgcgttgcgggtactcaagatcaggtcgttactgcacagcgggaattgtcccaagctcaagctggattaacgaccgtgcgcgcccggaccttggcaaccttaacagcagcggccgaaaagccaatgactgaaaaacctgtgggcgaacgaccagtcgttagtcattcaactggcacgtcaaccagcactaatcagtcggcggcaccacaagcgaccccggccaagcccactcttaatcagtcaagttcagcttccgtcccaacagcgcagcgggttgttacgacgcagccacgacaagccacaacggtattgcggacgacgacgagtccggcaatggctaagccagtgactcagcagacggtgccaacgaccgcaactaaaacggccacgttaccacagactggtgaacaaaccaatcgagttttgaccgtattgggcttcgtattattggccgcaactagcttatttggttttagcaagcaacaacggcgccataaaacaactgattaattaacaagtgtgtgggcacaattcgatttctcaatgattatttcgaagtgcaagactagtccaatcggttactttagtctgagcgactaaattgacggcggaattaatggcgatttaaaaaagttctttcggagttttagttgttcctgaaagaacctttttgctgggaatgattggtatcgtttagttaataataatatgctaagaacgccagtttttcggccggaaatacttgcttgaaagtagctgctggactactataaacatggtttcaaagagcccaagaattttactaaataaggagttgagtttgtgatgatgatgacgggaatgatggttctatttgtattgttagttggtttagttttaagtgggattttcttccgatatatggatacaactgccggtatctcattcagctcactgaagttcgctgatttgcggatggaattgttaaacttggtactcgttattggactattgctgtgggcactggttttaattcgttaaagcgacaattaaacttatcaacttagctattattgcgagtccggttaacgccggacttttattttggcttgtgattgacgaattatgttagtgcggccgccaaaatacttgcgcttcaacgtggaacaccgctattatggataagtgattattatctagaagggaatgaataactatgacgcagtcgccatattggcaacggatcgcggccaaagctcaggccgcccagcgaccgttttttagtttagcaccgatggaagccgtgaccggctccgtttttcgccgggtcgtgatgcgcgctgcggcccccgatgtcttttatactgaatttacgaatgcgttaagcattacccacccgaaggctaagtttacaacgcggggacgactatatgttgatgaggccgagtcgccccgaccaatcgttcaactttggggcaatagtggtgaggactttacgaaagcggcccatgaagtgaagaatcaaggttatcaagccattgatcttaatatgggctgcccagatatggcggtcattaaaaatcatagtggtagtgatttaatccgacattttgatcgtgccaaagaagtgattgagggcgcacgtcaagcagagcttcccgttagtgttaagacgcggttgggctttgacgatgtgcatgagtacgagacttggattccgtttttgttgcaacagcaggttcccgtgttaacggtccacgtgcgcacgaagatggagatgagcaaggtaccagcgcattatgagttaattgataatttagttcaaatgcgtgatactttggcaccagcgacgctattacaaattaacggggatatcctggattatcaggctggtctgaagcttgccaaagcccatccaggagtcgatggtatcatgattggccgcggtatttttcagaacccatacgcttttgaaccgattccccagcctcattcaacgcgtgacatgctagaattgttacggtatcaagtagatctgtatgatcaatttattggcttaggtctacaagggcatttcgcaccgcttcaacgcttctttaagatttatgttcgcggtatgcgtcatgcggccgaattgcgcaatgaattaatgcagacgaagacaacggatgatgtccgtgcgattattgatcgcttagaggctaagctaccagcggattaggtcgcgttattttaactaaaacggctatatttttgccatttagctgtgcttgattaaaatggttttaatgtcgaacgtaccgcatctaaagtcaactgcaaattaaatgctagcctgtaagtggaccataaaataagctaggtccttcaagaagtcgatttcttggaggacctagcttattttgtggtctaaattattgtaaaccggtcatcgagtaaggtaacttgttcaggtgataagccaacgatttgaagctcacgttgtttagtcacaaaaatggcgccgtaaatatcgggtcgctgagttgcccaatcgggaatcggttggcccgcaaagaagagccgcgtcgtttcgatttcaccatcaatggaagctttcgagaaaacggtgacactttcaaggtcgttttgtcggggataacccgtttgcgaatctaagatgtggtggtaggactggccgttaaattcaaggtgccgctcgtaaataccgctggtcacggccgagcaggggccaatcgtaacgctggcaatcgcgttaccgcggtcagtggtgggatcttggataccaacgcgccattgcccatccggatgaagtggggacgtccccaccattaacagattaccacctaggttgatcattccggcccgctgtccaaatgcttcccagtaatcttgaatgcggtcggcaatgtagcccttggcaattgcgcctagatccagctccattcccgtgaccttgagaagcacactgaaatcagcgtcattacaaatgacggcttcggggtcgatcaaggccaatcgttcgttaattgcagactgttcagggacgtgcgcgttagtaaaaccaatgtgccagagtttcacgagcggaccaatcaacgcattgaaaccaaaatgttgtcgactgagttcgacagcttgccgaacgagtgtataggtggcggcgctcacttgaacggggtgttggcccgccgcctggttgattgccatgacctcagaaacagtccggttgacagtcaagcggtcttcatattggtcgataagatcgcaagcagcttgtaggtactggtcactatcactaccaaaaagggtcaaatcaatgtcggtaccgagcgcgtgatgagcttggtgtcgacgctgctgagcgagtgcaggaattgctgtctcgccattataagctaaagttgtcataaaaccagtcctatctttcataaatgtcaacaagttcagcaaactgaatatttattcccgctcagttagaagtaggcacaattaaatcagtttccctgcacagtgatctaattcgtgttgaataatttgtgctgtgaagtcgttgaatcgttgttgttgcggtttaaagtgttgatctttatatttcaccgtgatttggtgatagcggctagtcggacgttcaccaggtaaggacaggcagccttccttagtctcgtaagtgccgtgatgatcaatgatcttcggattgatcattgcaattgcaaagggaccgagttgcacgacaataatttgtttgttgaccccaatcatattcgcggccattccaacgcaattatcggtgtgtgcggcgagggtatccagtaaatcagtcaagacttgagtgtctgcaggggttgctaagtcagcagggacactaagcgcggcgggatcatgcacaattggtcgaatcatttgatgttcctccattgattagtcatattaatttaattatagagagcacggttgacagaagcaagccgttcgctagttgtcaggccctaaaaaaaacaccacactcacacaagtcaacgtgcaaatgtggtgtggccttcaattagtacgacaatttaaatgttggcgttaaggtgcccgcctttaaggcgtcattagttgtggtgggaacctggttgtgttcaggctgccaatttggatctttaatcagtgcgatattagtcccttgataattcatggtcatttgattagcgtcgttgagggtcagttttgcaacattgtgatcgattgtgaacgtggcacgtgtatcacttaacgttaacgttgcgcgactacgaatgggcgtatgtccgcgtcggaaccaagcaacttgatgattggtactgaggtacagactcattgctggtctagcgctgacccagcgacctaagaaatcccgagtcgtgactgagcgaacggcgctgacttttgatgttgctggttgaacggtgggcgtttgtgtgtcagtggcagaatggcatcctgtcagtagccctgtcaacaacaagccgacgattattcccctgcttttttgcataattattctctcctccaatgtccacatccctcaatgaggacttaatttcattatagcgaatccgccgcatgagttaaacaaaatagtcataagttaatcagtttacaacaacttggttgtgttcagcttaatttttaacgaattaaaattcggtttatggcgtgtgaaaaatattgaaagcaagccgtatcaaggttggttcggtagttaacgagattgattaaatattctgatattagataaaaaatagtatgaaaaatatttttgaaatattccaaagacgcactaaccggacgattaaagcgatttggtgtacacaactgaaggtgacagttaattttggcaatgggcaagttaatgaaaatgagctactatatatagtattgattcaaacagaacgcactatcaattgtattcaatcaatgactttgaaaagtggggaattaaaatgctaacaacgacaactaacgatatattagaccaattacggccactgaccgtcacaaagcggggtggcgcacaaacgaaatttcatccgtataaaattgactttgtcctacgacagttgttagcgactgatgacgaggtacgggtcgtcaagcaggcccttgttgcccagtatcaagatgctgacaacattgatactcgggagctacgtagtaccatgatgcagattttgaatgcgcaaggcctgaccgcggcagctaaggcatatcaggattactttgaagctgaacagcagcggtttgcggcagcaactaatgttcaaggacggattgaaaagttgtttgagcgcgatgccagcgttgtgcatgaaaatgcaaataaggatagtacgatttttaacacgcaacgcgacttagaagccggtgctgcaagtcgcgccatgggcttgaagatgctaccagatgtcgtggctaaggcccatctgcgtggcgatatccattggcatgatctcgattattcaccagtcacgcctgaaacgaactgttgcttgattgattttgacggcatgttcaaaaatgggtataaaattgggaacgccgaagttgcctcacctcggtcgattcaaacggccacagcgcaaatggcgcagatcattgccaacgtggcttcattacagtatggtggctgttccgctaaccgtgtcgaccaattattggctccctatgcggcaatcaactatcaaaaacatatgactgatgcgaaaaagtgggtccctgccgatcagcgggaagcttatgcgaaagccaaaactaaaaaagatatctatgacgcgatgcaagcccttgagtatgaaatcaatacgttatattcgtcacagggccagacgccgtttaccacggtcaattttggtctaggaactagttggattgaacgagaaattcaaaaggcgattctccagattcgaatcaagggactcggtaaggagcaccgaactgcgatttttcctaaattgatcttcacgatgaagcgggggttaaatttaagtccgaatgatcccaattatgatattaaaatgctcgcgattgagtgttcgaccaagcggatgtatcccgaccttttaatgtatgacaagatcaaggaattaacggggagttttaagacgccgatggggtgccggtccttcttacaaggttggcgtgatgaaaatggtgtcgaggtaaactcgggccggatgaatttgggcgtggtgacagtcaacctgccacgaatcgcgttagccgcacatggagaccaacagttgttctgggaaatcttcgaggaacggatggcgacttgtcatgaagcactcgcgtatcgtatcgaacgaacgaaggaagctaagccggaaaatgcaccactcttatacatgtatggggcgtttggtaagcggctaccagcaggtggtaatgtcgatgagctcttcaaaaatcagcgggcgactatttcactgggatacattggaatttatgaagtctgcacgaccttctttggtccgaactgggaacaagacgagcacgcgttagcttttgcggagaccgtggtgaaagcgttacgggataagtgtgcgcagtgggcggctgaaagtggctatcattatagtctgtattcaacgccggctgaatcgttgacggatacgttctgtcgtgacgatattgcgaagtttggccggatcgcagatattacggataaggaatattacacgaatagttttcattatgatgtccgtaagcacccgacgcccttcgataaattaactttggaggaacgttttccacaatatgcgtcaggcggctttattcattattgtgaatatcctaatttgactcagaatcctaaagccttggaggccgtctgggactgggcctatgatcatgtcggctatttgggaacgaatacgtcgatcgaccagtgttttaagtgtgggtttaagggtgagttcaaggccactgcccgtgggttcgtctgtccagaatgtggcaatcacgaccctaaatactgtgatgttgttaagcggacgtgtgggtatctaggtaacccacaacaacgaccaatggtacatggtcgccacgttgaaatcgcgtcccgtgctaaaaatatgtctccggagatgattaagaatgccgcgcgctacgaaaggaccaaacaatccgatgcccaaagaatggctggcagaggacttaagtgaacaatatgttgctgattataaggcatttaactttgttgatggggaaggggtccgctgtagcttgtacttgagcggctgcccattccactgtccaggctgttataatgtggcggcacaaaattttcattatggacaaccgtattcacaagaattggaagatcagattattgaagaccttgggcaagattatgtgcaagggttgacgttgctaggtggtgaaccgtttctaaatactcaagtcggcattcggatttgtgaacgcattcgctccgaatttggaaacacgaaggatatttggtcgtggtcaggttatacttgggaagaattgcaacaagactctgaggataaactgaagatgctatcattaattgatatcttggtagatgggcgctttttacaagataagatggatctctcgctacaatttcgggggagttccaatcaacgtattatcgacgttcctaagtcgctaacagctggtaaagtcgtcatctgggataagttggttaagtgaaattaagactggtaaaaagagcgttatgacgaggtcgtcacgacgttcttttttgttacggtcaatataacggttacatataacccttaataatttttttaattaaagtctgtaactatgtctcgatattttagttaaaagcggttatactttacaggagttgtcaatttatattgacataaagaaatcattaaaagcgaggcttcatgaatgtatcgtttttttgttcaaccccaagttgatcacagccatcgagctgtttttggttatgaattactgttacgtaaagagatgaatggtcactgggccgttccgaagtcgttcactgaattatcattagataaacaagctgaattattagaacaacttgctagtcaattgcagacgaaagcgactaatcaggtgttagcccttaatttaaaccggcaacaagctgaggacgacctgatgttagggacgatcatttacctaaaaaaaaggttgaatccggccgcgctgacgattgagttgacagaatgtccttcattaaacgagattcaaaaatatagtctctttttccaccaacatgatattaaattaagcattgatgacgtggggacgggcacgaacacgtttgagaatattcgccacgcactaccgtttgttgatcaaatcaagtttgcgatgcaaaacttacggatgagtgggcaagcggagcgcattcctcatgaattagcattttggcgtgatattgctcagtcttaccatctggaatttattctggaaggtgtcgaagaccagggtgatcaaaagatggccgaacaacaaggtattgaatggcaccagggttactattatgggaaaccgcggttagtcgatgatggtcggcaattggtcaacggcggatgctgagaaaggatccttacgatgacatggtctaattggcgaatttcgccgttcgtaacgagtattttctttatattaggtgttctaacactttactgggtcctctttaattggattacgacgtggtttcatgcccgtcacattaacattgacgatgataccgtcaatgcttggcacggtgtgatttacatgttggtctttgtgtttgtcatgcaactgtcggtcgtcggtaaagcagatagttgggagtttgttaactttcacttgattgccgtcgtgttctgctcgttttttttgaatattcgaatgccgtattattcattgttacctgtggtcatagtgtacatggttttcgaccagtcgattttttactgggaatcgtggagttacgccgtcgtgttcgtgctatttttctggagcatgaattatctacggctgtgggtacctaagcatcggtatccttggctatattactatggcgcggtcgctttttacggcggaatcttgtggggcctgatcaagcttaaatattcgctggattgggacaatactttacaagaatatggctacttaatgatttttgcaggattattgtacgcctacgttaatatgctgacccaagatagtgagattaaattacggttggcccagtttgcgagtcacgacgctttgactgagactgagaactttgccgcttacacggaacatatcaaatatttattcgatgatagtgccaagaacaatctcaacttatcgatgatgatgttcgatattgatcactttaagcacgttaatgacacgtacgggcaccttgcaggggaccgcgttttgcaagaagttgccgccacggtcacaacggtcttggccgccaatgacgagaaggtcaagctgtatcgcaccggtggtgaagaattcaatgtcctgtttcccggttatgatctggctagtaccaaagtgattgtccgtcaggtctttgaagcagtcaatcatctcgttgttaagtatgaagacgaggaaatcaatgtgtcgatttcggttggtgtctcgacactgcatcaagccgatggtagtccgattgatttgtacaaccgtgttgatcagaacctctatttttcaaagcggcacgggcggatgcgtgttacggttgaatagtggctgagattaaaaataaataacgttgacttgttgagctcccggaataaaagccggaagctcttttttgctcgcaatcggtctgactgaaattgtaggcctaaccgtcattgcctgattgacgtattggggaaacatgatgtcaaatctacaagattgcttgagtgcgacattggggttatggtggccaatttcagctatttagtagcatcgttcgttaattgagtttacgaattaacgctaacagatgtaaaccttaatcgaaaccgttaattatgctggcattctagtttaattatggtatggtttatgttgtaaagataacagtcaatgacttaaactaattgacttacatattaaagaaaacaagttttttacgttacgtttgttaaggttatttaaatacgaatggttgccaatttataaagtaaggaagtgagaagtgtgccagtggtcattagctcattaattcccgtagttgcgccggttaaacgccaagtgatcaatgtgacgacccttgcaaatacggttcacttatatgggttactaggatttaagcagcaaattataccggcaacagatcaaattgttgcgccctttgctggggttatcacagccgtggcagccaatcaacggttaattggctttcgagcggccaatggtctggtgggctggctacgaattggacaattaaccagtgctttggaatcgcctacatttaagttcaacgttaaaccgggtgactgggtagttgctgggcagatgttggttgaagtgatttcactactgacacaacggctccaaccagttaaaacgacggtggtattgacgattagacatgcggttgttcgtgttcgagaacggttgctggcagcaagtaatcaagtcgatccgatgggaactgttatctcaggtattacgaccagtatggctggtaatcatcgggtcgcaacgatcgggccaccccaaggtaattaattgtttgacaataagcaatcgacgtcctagatacggggtgtgtctagacgtcacgcttcgacgcagcccattgaatgggcagtagtggctgaggtgtgcgttttaataacgcagttaggggcagtgctggacgcatgaacagtactggttcacaaggtcgccgtactaggaggtacggcgtcgctgatgttataaggtattaagattaagtagttgtgggtagcagtaattggtcagcgattaagttttggcagacttataagcacaactgctatcacgggtacgattaattgggtgctaacgtaagtatggttacctagttaattaagtttcgtcggtcaaaggttaggccggtattaccgagatggttgtgggggtataactacttcggcgatcgtttgatgtcgtgttatgttcaagataggtcaattatttggtttaagaacggatcacttgcttttacttggcagtccagtttatcatgacggtaaattgtgaaggagtgattcggcatgaattcagcgacatttaatcaaactgaattagcaaaatataatggtcaggatggtcaacccgcatacgtggcggttgatggtgtcgtttatgatgtaacgggggttgcagcatgggctggcggtaagcatcatggtaatcttgcagggcaagaattaactgcagtcatcgacaccaaatcaccacatggacgtaaagtgttaacgggactgaccgtcgttggtcaatacgtgactaattaaattattgaagactggttgattgtgaccagtctttttttgtgtggataggcggctgttgtgattgcttaaacgagctttcacaccaaaatttttcgtactgcgaggcaagtattgaccaattttaggcggctgtttgtgggtttgagacattgtgtaaaataagtgcgtgatgataatcgatattccaagtaaacgaatagataacaaaaatactaacttatgattagttaagacctgtaatggttgctggcacgtctattgacagtcatccactgtttatataacaatacaaaataaattatataaagagttgaatgttgtatgaaaaagcgtgaaaatagaattgaattaaaggaaagttaataaactatattttaggtgggtaaatgatggagcgaaaacggacgaattttaaaatgtacaaaattggccgtcgctgggcgtttgcatgtgccgttatcttgacgatgggcacaacaacgctggtggctcgggctgatgatggaacgactgcaacggggactgatacggcatcaaccagttcaagcacaaccaaatcagtcacggctaagacacaaactttgaagactgcggccacaactgaagcggatgtgactaaccaaaatcagccggttttagataccgatggttcgaattcaaagactgctgctggcacagtggctggaactaaggcggcaacggatactgatacaaacgctaccaccaatttggatgagacaactagtgccaatactgaaactggttcagatacgacagctggttcaaagacggcaaaagagacgaatgcgacaaccggttcagagtcgacaaaagagacgtcgaccacaactgattctgccactgcaacggctgcgcggacaacaaccagttctaataaaggtgcgactactgactcagctaccagcaatgataccgcggcaacggctgctaaaactaccgatgctagtgctaagattgccggtacgacgactagtgatagtgtagcccagcaaacgacgacaactaaagaccagtcgacgacaactgcaacgccccagaccgtcgcggtggcgcttagtcaagctgtgacccatgcaaacgatgccgttgccgatggtggtaatgtgacggacgattatccggatctacataacatgctcggggtttcgtcccaattccatatttttgcacgggaagcggaactacatgcccatacgaatgggaacgttgcggtgcaaaacttagtgggcaacgttaactttggtacgaacattattgaagaattattagataaagatatttcgtatattcaaaatatcagtaatattgctgggagttcgtttgtttcggctggtgagacgcggagcaataaagttatctttggcgaaaatattgagattgatgtttcgaatcctaatcggccgatggtcaacggggtctatatcgaccatttacttgcctctgaagtttatcaagacaaagatggtaacgtctatattgattttgacaaagagtttgctaagttggaaaaattgagcgctagtcttagcgaagcgtccgcgaacgccacctatacgagtgacagttttgaagatatgaatcagcgggtcatcgatgtgacggatatgcaacctgatgcggatggacacattgtgatcaatctgtcagcggatgttttaaacacgagtacgccgctgacaatcaagggactatcggcagatgcggatggtaatacggtcattattaatgttgatacggcaggtgcgaccaactatcaagttaactcgcagatcaaaatcatttatgatgacggtacggagcggaataataaagaaactgaagactttggtgataaccatttgctttggaacttctatgattcaaccgcgagtgacaagttagcaactggtgtcattagtgtcgaccggccatttcaaggcagtattttagccccagcggcggaaattgatgcaaatcaaaatattgatggcaacatcattgctaataaagtcaacgtgaaggcggagacccatcgttgggatttacaggataatgttgataatgaaaatgatccagaaccagttccggactatgagaaaccggtacatccaagtattgatgccgaattaccagatggtggcgagggcgaagagccagaatacgacaaaccggtacatccaagtatcgacattgaaatgccagatgacggcgagggggaagaaccagaatacgacaaaccggtacatccaagtatcgatatcgagatgccagacgatggcgaagaagaagaaccagaatacgacaaaccggtacatccaagtattgatatcgaaatgccagataatggcgaagaagaagaagagtacgacaaaccagttcatccaagcatcgatgttgaaatgcctgactttgacgagattgaggacgaagaagaagctgaagacgcagaagaagaatttgaagacgatattgaggatgaaatcgaagctggtgtgacgccagacgaagttgtcgaccaaatcgaagaagaagtcgacaatgaaattacagctgactgggtcacggacgaaactgcgactgaattggaaacggcgtttgaggaagttcaaaaagaagcagtggttggcgatcagattaaggatgaggaaacactgatcaacttgattgaccgggcaatcgcacaagctaaagcgcatcataatacggcgttagtagcgcaattacaagctctacgaactaaggtggctagcgcgttggcagtggctaaggggcaagcattaccacagactgatgaagcgccaagtcagatgattagtttagcgggaatcgcattagcaagtacattagtattaggtgctgcagcggttagccggcggaagcgtcagtattaagcttaaaattgtattttgaagcaactgttgattcggcaagtttaatcttgcgaatcaacagtttttttgcataaaaaagtcactaaaccaaattggtctagtgacgctcaattctctctactccatgaccgacctaatctcttgaccccaaatgcgccactagtgaaacgtggtataaatgctaacccccattagcatttatgatatttattataaataattcagcacattagtcaacttttattcgaatatatttttaatttatgttgaaacctattcacagataaatttaattgaccgactgaattggtctaaagtaagtaaccataataaaaagctggatggtccggatgaccattcagctaagtaatgttggtaaggtttaattacgaattaattcattgaagttaaattcgttcggaataaagtgggattcagtgtattcaacctggcgtccttcatcgttaaatgcgatgctaatcatattaccgacgcaattattatcaccgagcgctagctgagctttgtcgagttcgttggcggattcgactcgtagcattcttttaacgacagcaattttcagaccattttttttgaagtgttgataaattgagtgttgggcaatggtcttagtcagagtgggagtgcgctgggcgttaaaatagttaatgtccagcactgcccgaataccgtctacgatccgaacccgttgaatagcatacactggaatacccacttcaaaagcggtatgtgtgctaagcggctggtcaacgattcgttgctgaaaggccacgacctcggtctgataatcgaggtggcgctccgcgttgagggtctgcagaccgttgagattatttaaagccagattgaattgctgggtttgtggcgtgtgctccaataagaccaccccgcgccccttaacgctgtaaactaggccgtctttggctagttgtgcgattgccttacgaacagcatagcgactgctatcaaattctgtaattaattcgtcttcaatgggtaatcgcatcttaacgctgtagtgtcccgtgagaatgcggtcctttaaaacgtgatagatgtcgctgaatgtttgtttccccattttaatacccccgctcatcatataattaatttaattatagcaaataatagtcattagcgagtaaacaagcgaataaatatcgatatttattcgaataaaaattgacaagcaatcatgtgacctactataatgaaagcgaaatcaagtcggtaatacgggagtaggagggggaacatatgcaagttgaacagcgcacattaaatactgcggcacacccatttcagatcacggcgtattggttagaccaaattagtgattttgaaacagctgttgattatccaatcatgattatctgcccgggaggtggctttacttatcattctgggcgggaagaagcgccaattgcaacccggatgatggccgccggaatgcatacgttggtcttgaattaccaattaattgtgggagatcagtccgtctatccttgggcgttgcagcaattaggtgcaacaattgattggattacgacccaggcgtccgcgcaccatgttgattgtcagcggattattcttgccgggttttcggctggcggccacgtggttgcgacttataatggtgttgcgacccaaccagaattgcgcacacggtatcatttggatcattatcaaggccagcatgctgccattattttaggctatccagtcattgatttgacagcggggtttcccacgacttcggcggcgcgtaatcagattaccacggatgcccggttgtgggcagcccagcgcctagtcacaccagctagtaaacccgcttttgtctggcaaacggcgacggatgagttggtcccgccaatcaattcgttaaaatatgtgcaggccatgctacaacatcaggtcgcaactgcgtatcatttatttggtagtgggattcatgggttagcgttggccaatcatgtgacgcaaaaacctggcaaggacaagtatttgaatgaccaggctgcaatgtggccacaattagcattgcggtggttacaagaacagggattgttagctggtaattattgaaaagaaatctgggcgatcagtcgtgcctcactgatcgcccgttttttgtcaacgatcctgacaccaattaattttctgcggtataataatacgaataagcttattaagtaagaaggagcgattgagatggcaacaaatcaacacttggtcattatttccttagatgcgttaggatttcgtgatttacgcgaacatcaagcagaattacccgttctgagtgaattgatgaccggtggtacttgggtcaagtcggtgacgggcatttatccaacactgacatatccgtcacataccacgattattacgggacagtatcccagtgtgcatggaatcgttaataatactaagttacaaccgacacgccgttcaccagattggtattggtatcaaaaggatgttcaagtaccaacactatatgatttggcacggcaaaagaagctaacaacggcggcttttttatggccagtgacggctggtagcaagattacatataaccttgccgagatctttcctaaccgcatttggacgaaccaagttctcgtctcgttgaaggcgagttcaccgctcttcttactcgcgatgaatcataagtatgggcatcttcgtaatgggattaagcagccccaactagatgaattcatcacggcttgtgcagtcgatacgttaacgaataagaagccgaacctaacgatgattcacttagtcgacatggatagtatgcgccatcgctatggtgtgcgatccagtgaggccatggcagctttacaccggctagaccggcacgtgggccagttgattgacgcgactaaagctgcgggcacgtttgcggataccaactttgttattttaggtgatcactatcaaatcaatgtggatcacatgattcatttaaatacgttattcgctcagcagggctggttgaccgcacgtcaagatcagacgtttgaagatgactggtccgtgatggcgaagacggcggacggctcaacgtacatttatacgcgaccggaatttgaccaattggatgaattgaaggcattggttagtcaggttgaaggtgttgagaccatcattactggagaggcggctgcacgtcgtggtgccgaccccgcttgtgcgttgatggttgaagcccaggaaggttattattttactgatgaaagtcgacggccaactgtggttgaacccgtccatccagcgacactcggtcaaccagaccgttaccacggggttcatggatatgacccgacgaagcctgactatcaaacgaccctgttattcaatggaccagcagttaaagctggtgggacgattgaagcggctaacttagtcgatgaagcgccgacatttgcgcggttactcggattgagtttcgatggccccatgccgggacattgcctcgatggtattttcaaagactagacaaaaaagagagagaggaaaagcgggcggacatcagcaccactaatattgtggttaatgctcgttccgcctccgattgcgatcagaggttcccgcgaagtaacttaatgaaatttaataaacagcagtggggttggatcttttacgattgggccaactcgggctatggcattattgtcacaacggcagtgctacccgtttactttaaggcagttgcccaaagtagcggtgtgacaccggctaatgcaacggcttactggggttatgccaatagtattgggaccttactagtttcgattttggcgcccgtcctaggtgcactagcagactatccccatgccaagaaacgaatgctcaacatcttttcgatacttggaatggtgatgacgctagggctgagtgttgccccgactagtgcctggaagtggctattaggtatttatattttatcaattatcggttattccggtggtaatctgttttatgacagttttctgactgacgtggcgccaaacgatcagatggatcgattatcgtcatatggttatgggtttggctatctcggtggtgtcttggcgtttatcttattcttggtcttacaattaaccagtggttttggtcaattatcaagctatggggtcgcgcggtggagttttgtcttagccgctgcgtggtggattatcttttacattcctttgttgaaaaacgttcaccaaaagtacgcgttagcacccagtgcacatccggtgcgttcaagttttcaacgggtatggtcgactttgaaacacatccagaattatcgcgctgcggcgtggttcttggtggcgtacttcttctacattgatggagtcgacacgatctttacaatggcaacttcgattgggatggatatgggaattacgacgaccacgttgatgatcgtcttgctggttgttcagctagtcgcgtttccgttttcactgctttacgggtggttagcgaataaaacgtcgacccggacgggcatcttgtttggcattattatttatttaggtatctgcttgtacgcgttgcggttgaatagtacgacggatttttggattttagccatactagttggaaccagtcagggtgggattcaagcgctcagtcgttcgtacttcggtcgtttgattcctaagactagtgggagtgagtttttcggcttttacaatattctcggtaagttctcagccgtgatgggccccgtcctagttggaatcgtgacccaaatgacggggaagtcaacgattggtgctgcttctttaagtattttatttgttgttggattagtgattttcttggctctaccgcatttgaaccagacaaagtcggtttaagccaggggttgttttatatcatgtaaaaagaggctgtgacataagtctctagaaacaaaacaggtctggaaaaatcttcggatttttccagacctgtttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtgccatgttaaaactggtccttttagcatactgctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgatctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttgaataaacgacgtgataaaatgcgtgaacaccaagcacagcaagcgatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaattggtcacggtagggaccaactttaaaaatcaaaggcgtaagcaaatgggacgagaaaccaaaattcggtttctcgtcccatttgcttatacagaggctagttatgtcacagcctctttttacgttgctcaagctcagaccatcatgagttataaattcatttccgtattccgctgtaatacacgcaagatgagatagtagccaataccaataagtaaccaaattccgccaatttcttttgctaatacgtttaaattaatcataacgaagccaataatgataaaaccgataattggtacaatgagatgatgccaatagtcatgggaatgttgcttgataaagaagtggttaataacggcaatatgaatcactagaaaagcggtcagggcaccacaattgacgatttcagagagtgtcccactgtcattcataaaagttaacccgacaagcagtgaaataatagctactagtaaagtactcatatatggggtcttgaatcggggatgtacacgggcaagaacgtgtggcaaattgtggtcacgggccattccgaataggattcgtgaaattgcagcttgggcagctaatgcattggcaaatccccaagagagaatggtggcaatagtggttaaatcagttaggaatgggccaccgaccttgccggcgacgacgtaaaatgcagtgtttagatcgttaaaagaatgccagttaggaacgattagagcagctaagtaagtctgaatgatgaataatgcgcctacaattaatagcgaccataggataccttttcccacagcctgattaccaccagtggtttcttccgctagggtactaatgccgtcgaaacctaaaaagctgagaactgctactgaagtggctgtcatgacaaaattaagattaaagtgacttgcgtcataaaatggttttagtgtgaaaccatttccaattccccgcattaagccatagctcccgaggataatgaaaaaagcaagtacaattaattcaccaatgagaaaaattcgatttgcaatagcagtgaaggcaatgcctccaacattaataagggtattgattgcaataaaaccaaccagccatagccaagttggaatggttggtaggagggattttaatgaattggcagcgatgatgtagagtaatgcggggacaaagatataatctaaaataatcatccaaccagacagaaaaccaattgatttattgatgccaagttttgcataggcataaactgatccagccacgggaaaggcctgtgacatttgtccgtagctgagagcggtaaagaacatcgccagcatcccaatggcataggtcaacgcaatcataccttgtgaaaccgaaataacagcgccataaatccccattggtgcgattggcaccataaagattaggccgtaaataaccaaatctttaacagatagtgttcgttttaattcttgttgatagccaaattcgtcaaggttagtattagatgaactaggggtgtgttttaaatccataggcaatttctcctcagtatggcataaagtcagggcattgagatggtaaacgagtgagcgtagatgtttccataaagtggcactgtggttgctggcgttgacaattagtgaggcgtcgtttgtcgcaactgacaacggtgctttgttagcggcccaattgatcagaaaaatagtttcgtagataagtaaagaatacggctggattatcgaccatatgattatgcccactgtccggtgttacgactaactttgcgttcggcatgcgctgttgcattcgttcagccgttgctagtggcatggtttcgtgatcagcaaacattaacagtgtcggtacttggattgttgcaagtgtatccgagaagtcccagtcatcaagtaccccataaacgacaaactcgttgtcgccttgaaaatggttgtaaacgggcttggcttgaatatcgagttgatgttgcatcatactggggtgacaacgattgatatattggtggtagaggtgtgttattaattggcgatagtgggggttattccattgttgacgtttttcaattgcgagcataaaggcattttcagctggtgaaaactccgcggtgcgaattgcgtgcatccgctttaagtaatcggcaatattgtcgatcatgctaatgatgattagcccgtcaagttggtcttgatgatctgctgcgtatgtcattgcgagcatgccaccccaggagtgacctgcgagatagcagtgtttataccctaattgttggcgaacctcatcaacctcgctcaggtaataatcttcggtgagatactgttgtcggatagcatcgtcgtcccagttaggggtgtcggagtaccacgaaccgagttggtcatacatcgtcacctcaatgtcgaggtcggctaattcaggaccaaaacgttcaaaaacttcatgagtatctccagggccaccgtgaaggcagagcaattttgtgcgaccgcctaagttactagtgtggctccaaagatgatacccattactaagcgttaaaattcgtgtcacgtttttcattaaaacgcctccttaattatttggttgacatagacgatacgccaaaaactaattattttcaaatctaattttaatgaagacgcctgctcaccagtatcaatacatactaaaaatcatacatgtgcccaggtgtcaccagtttttgatggggtctgtgtgtacacttacggctcaactcttacgatttgtaaactaagtaacttagcgctaactgaacgagcatcttcaaggttgagtaaccctgaagaaccagacagggctatatcaaatggcagtttctcagtgggccttgcagattgttggtctttgggactggcgcaagtgagactgtattattcagtaagccttaggccagttaatcagtatgtgtgattaagaaaaagcctgttccagtctggcataatttattgccaggctagaacaggctttcggtgttaaagatgcttgtgagactgatgcgattggcgataagtctgggcttgcttagtgcgaacgttacgaattgcaaataacgtattatcaatccgggggtgatgatgtgtttctaagacgctgacttcatcaagcaattggttgccaatttgccagtcgccaaagtagagattccagatgccaagccagaattgttggctcaaccgcccatcccagtttaactggtgactgtcgatggcagtgaacttggttttcagattttgagcggattgaaaatcatgaaagttcaatttagtttgaaatagtgatccataaaaatcgagtaagtcgttgctgacgtgaaagggatcgccccaagccgtttgataactggcacaattggcggccatacgggttgtcagtggtgttagcgcggccaagccgtcgatggatgcaataattggaattagaacgggcactaattttagttcctgcagggtccaagtcttggcttggcgcaggtgatcaaaagcgggctgggtcgtggttgttatgccgattgaacgatggtcataggatagcatcaagatgctggcataactggcgatgagttgttcgtaggcgtgggggctgtgtcgatgttcgcgaatccaagtggctagggcgggaaaatttagcgtttcataagcgtgacgaattgtccaaagggcctggtcatatgctgatggctggtagttttggtgtatgaatcgtaactcgtcggctgaaattgctaagttatccagaattgcaaagagtttactggcgccaatatcgttggcaccactctcaaagcgtgaggcgaatgagcgcgagataataccgctatacacttcttgttgagttaagcccttacttaatcgaatctgatgaatagtttctccgatgtttgtcatctagcactccttaatgtggcatatatgcaacctacttgctgattgtaccacggtaatgacgagtaagctaagtccattatcttaatgggagatgggttaatgctgactttattaaaaaatcggaccctccaaacgattgctagtgcaaatttttttacgacgctgggggtgagtttgttcaatatcattttactcacgtacgcaaagaattttccaaatccacattggtttgttgccatcgtttcggtggtgacagttgtgccgtacgttttcgggggattaacggggcgactcgctgatcagacgcgccgaaaaactaactggctgattggtactaaggtcgttcaagcggggttatatctcgtcttggcccaagtgattactcagcaaacggtggttgttttctacgtggtcgttgcgattaattttatttcggatctactaggtcgatatggtggcagtattttgacaattgttattcaagaccggattgatcctgacgatcgccaacaagtgatggggcttaatgcgagcataagtacgcttgttgagccactgggtcaaacactaggggtcttgattatcgcccagtggcatgattatgcgttagctggaatagtgaatgcgttgacttttattggggccgctagctgcttgttggccggacgttcagcgattcagtcgactcccaaagttgctggacgaccacgacatattgaggcctggcctgtgattcagagagtgatgctgacgacgactagaatgggtgcagtcagttatctgggtattctgatgattttaaacgtcgcaacgatgagcattgatgcgattttgaacttaatgtttattgacttggcgtcccgcatgcccgtgagctattcggtcgcaattttaatggtcaacgtggtctttgttaccggaagcgtattgggtggcattactaaaaatacttggtttgatcggctctcattgtttcaattgttactggcagcgatgctagcgccgatgctgacctatgtgattttactagtcgttccacaactaatcttgattcttgggggcatgtttgcagtgggcttcatgagtggcaaactggacccgaagatgttcgccatcatgatgccacaaattgacccgcacttaacagggacggtctttggtaccatcagttcgattgtgacgttggcggcacccgttggtagcgtcggcatcgttttattatataacttagttggtgcgacggcggcgtgttcggtgatgattggtgtgagtgcgctggcgttgatctgggcagtgatggcgcaccggcagtgattaattgttaatcttttgttattgatatttcaatttggcgttaggatgtggctatcagctttgtgatgacttacgaatggatttagtgaaatgcagtgctcaaaaagacatcttgggacggctgactaactgaaatggtacattaaggaaaaggacgttagtttcgtccgcttcattggcaccatcgcagcacaacaaaagcgtgtctaacccctagcaagttgactagctgggggttagacacgctttttgattaaatattcgataagaccgttgtgatgaatgaggtcggtcatcagttcattggttaaacgtggaatagggccaattgcgtcttcaaatattgccctgttacactagttggattttgactaacggctaatggggtaccggtggcgacaatgttaccaccgttgataccgcccgcgggtcccatatcgataacgtaatcagcgttggcgattacgtcgagatcgtgttcgatggcaatgacggttgccccttgctgaatcagttggtcaaagactttgacgagttgctgaatgtcgagcgggtgcaaaccgactgaaggctcatcgaagacaaagagcgttcccgtttggcgtttgccaatgcgggaggtgagcttcaggcgctgagcttcgccacccgagagtgccggcgtactttcacctaatagtaagtagcctagtcccatatcatgcagaatctggagtgtattagcgatggcggattgcgctttgaaaattggtagtgcctcgtcaaccgcgagatctaaaatatccgcaatcgaatagccatgccatttgacggtcagcgtctgtttattgtagcgcttgccgtggcattgggggcagacttcggtgatgtctggcaggtattgcacatctaaggagatttggcccgtaccaccacaagttgggcaagcacccgcagcgacgttatatgaaaattggctagcggtccaaccgtttgcttgtgctgctggggtggcggcgaataattggcgtaggtggtcgagaatgttggtataagtggcgaccgttgaccgtacattcttaccaacgggcactgagtcgacggtaacaacgtgccgaatgtgaccattgtcaaaggccttaacgtgggttgggagtggtcgttttttagctgtggcaatcagtgctggaatcaaactatctagtaccagagtcgttttaccagcgccgctcatacccgtgacggtcgtgaaacggtttttgggaatgcgcgccgtaatgtcttggatgttaaagtgatgagccacttcaatagcaagggccccttttttccagagcgcatcgtcggttaatacggggcgttcacgcagcgtggcagtaccggtgagaaatggcgcaattaaggactctttgtcctgcttgatggctgcgacagtgccttgtccgacaacggtaccgccgtgcttaccagcccccggaccaatctcaataacatcatcagctgcactgataatactagtgtcgtggtcaaccaccacgacggaatttccttgggcgactagcccgcggaaagctttgattaggcccgccacgttagctggatgaagtccaacggaaggttcatcaaggacatataacacgccagtcgtggcgctacgcaaagtgcgtccgagctgaatgcgttgtaattcaccagttgacagggtcgcgccggggcgactgagtgtgaggtagtcgagtccaagttcttccatgggttgcaggctgagtagcaattcatcaacaagggattgtccaagatgatgcatcttagtaggtagccacgggacaatcgtggccgcaaaatcatgcaaggcggcgacagtcatatcactaaccgtcgcaatgttttgaccatttaattcgtagttaaacaactgaggattgaagcgtgatccgtgacaatctggacaagtatcaaacttgtaaaagcgattcagccgagtaattgcccgttcatttttggtcgtcgccatactatcttcaacggcggcaaaggcgttctcgtagacagcgttgtccatgtgaaagattttacctttagcgcttggaatgttgatggcaacggtttgcttaggaccatgcaatacgcgtgttttatcggcttcactaaggtctttatacggaatatcgatgggaattccaatttcgcgtgcaacgatcggcataaagttacgtccaggcaggtgccaagaagcaacggccccttcttcgatagtttgattttcatcagcaataatgagtgccgggtcaatttggcgaacttggcctaggccaccgcaagtcggacaggccccacctgaattgaaggcgaaatcttcggcgccgggcgctctgaatttggcgccacaagtcggacaggtgacgtaaccatcattttcagccacatcgagcgttggtggcatgcggtgaccattggggcaaactgctgagctgagtcgtgagaaggctagccttaagatatttaagctttcagacatggtgccgacggttgaacggacgccgggaacctgggggcgttggcgtagcgctaatgcagatggtaagtattgtactgaatcaacactggctttgccgacctgattgattcggcggcgggtaaaggttgacagggcgtttaagtagcggcgggccccctcagcgtacaggacgcccattgcgagtgatgacttaccggacccactgcgaccagtaatcgcaacaaattcgttgagtggaatgtcgatatcgatattttttaaattattgacgtgtgcgcctcgcacttgaatgtgagtcggtaacgtggtttgtggcatgactaaaacccctttcgtgtcactttatatgctacaacaaaagaacggctttgcctaagaaagcggtggcagtatctcgcgccccacgaccgggggagtatgataaactagggctaacgattattggagggggcgatggtgagatgtcgaagaagcgacgattaagttggctgagcgtgctcggactattggcaggattttgttggtggtttagcttagcaatgcgcgcggctgcggattatgatattgaccaatatcaagtcaatgtagccattcaacgtgatggtagtgcgaatgtaacgcaagcgatgacttatcaatttgatgatgattatcacggggtatttaatgttcaagatttgaaaggtattcagggggcccagttggaaggggtcacgacgcaactgaatggtgggaccacggtgagggcggcgccaagtgaaacgggggccaacaacacgtatcagttgacccaaaatgctgaccggatgcgtgtcaagctctaccggcaagttcaagaagatgataagttacgggttgtctatcggtatcggcttaaaggggtcgtaacgaactatgcagacacggccgaactgaattggaaagtgattggtagtggctgggatgtaccactgaataatgtcaaaatcgtgattcagttacctgccaagaatgtgagcgcgttacaagcctggacgcacggaccgttgagtggtcagacaaaagttgagcgcgcggcaggccgggtgacgatgacgttgggacataatcccgcgaaccaattcgttgaaagtcacctactatttccaaccacggtcacggcgacgaatacgcggacgaatactgccaagcgaaaagcgacggtccaaaaacaagaagctaagttggcacaggaagctaatgaaaaacggcgacgtaatcagttactgcgtcgcgttatctttggtgccgcggtggctggttggttattggtcatgattggctatctttggtggctggctcgtcatccggctaagccacatcagcagccgattcccatcaatcattcatttgacgtgccaccagtaacaccagcagttgctgagtcattgtgggcacagcggtcgccgaatacggatgccttaacggctgagattttgcgagcagcagctaatcacgaaataacgattgaaacggttgcgggtcaccgaaaaccggatgtgcggttaacgcaattgaaaccagtgactaactcatttttggctcactgttttgataaaatcgcggttgacgggcagttcatgttaacggatctcaaaaaatatgggaagcgtgataaagctggtcggttgggtaaatggtttagccgctggcagaccgaagtagaccaagacgtggcggtctatcaagacgaaactaattatcggcttcgtaatcaatggctgatggcagcagttgtcgtgagtgttatggggatgattgccacgggtgctgggttattagttagtccgaaggtcgtgaccctgatggtgattccagcggtagtggccgcggtggctttctggatcggctgaataattcaaaggcggcggattgccatcaatactgacgcaggcttggaattacgtaatcaaatcaatggactacgccgcatgcttaaggatattgggcactttaatacggcccaagtcggtgatttgattttgtgggaacaaatcttgccatacgctgcggcttttggactagccaatcaagtgactaagcaattggcgattgattttggtacggaagcattggctacggggatgctcgtgtattacccactcttctatgcgaatggtgggctggacttcgatttgtccggtgcaatcaacgatagttttagtggcgccttagatgcctctggaagcgctagttcggcgtcgggtggttcaggaggcttctccggcggtagttctggtggctttggcggtggctccggtggtggtgccttctaacaaagtatcagaaaagacttgtactttgcgggcataatcggtaggctaaggggtagaaaaggcttacatgaaatggatgattagtaatgacgattaaattaatagcaacggatatggatgggacgtttttaaatgatcatggtgattatgaccaggagcggtttgccaacgactatgcggcgctacagcggcgcggtattcagtttgtgattgccagtggtcaccaagcggcggaactagccacgacctttagtgcttaccctgaaatgtggttgattggtggtaacggcgcagaactgtggcaacgagaagcgggactcaaagccgcgacgttcagtccccaagcgactcagcaagtgttagcggccctggcaccgtatcctgaattacaagtggcattgtgtggcacccaaacggtccatgtgttggcgcacgcgaacccgcagtttgtagctaatatgcgtgactactattaccaattagagacatgtgcggatttaaccacagttactgatccggttgtgaagttcgacgttatttgtcccgcggcaatgacggaccagttagtatatgaacttacccctaagctcgctggcattgccgtacccgcttcaggtggtcagggcagtatggacttgattcagccgggaatgcacaaaggccgcgccctcaaacagcttggtgaacagttgggtattctgccggatgagatgttagtttttggcgacggcaccaatgatcttgagatgtttcactatgcgacccatgcggttgccatgcaaaacgcgcctgaaaatgtccaagccaatgcgacagcggtgacaggtaccaatgtggacaatggtgtattggattatattgaacaacatattttgagttaacttttgtgagaccagtattttgctaacttgggttacttggtgtgcgtgatgatcgtcagacggggtttgggtcgcgcaagcctgttcactagacatggttaaaactggtgtttacgggtggggttaatttggattgtttatgaaaatgatgagatgctttcagaaaatcacgtatggttttgattgccaaacgagctgaaagcatgctaaaattaaagttatataattaacgacacagaggtctggaaggtttgtttaattccgacctcttttctatcggacaatttcactttaaaaaagaagaggtaatggaatgctcaccgtaaataatgttagtatgcagttttcaacacgtaagctttatgaagatgtcaatttaaaattcacgccgggaaactgctacggcgttattggtgccaatggtgctggtaagtcgacgttcttaaaaatcttggaaggtaaattacaaccgactactgggacggtctcgatggggcctaacgagcggatgtctagcttgaatcaaaatcactttgcttttgaagatgaagaagtgttagcaactgttattcgtggtcacgaaaagttatacgaaatcatgactgaaaaagatgcgttgtatgccaagcctgattttagcgatgaagatgggattcgggctgctgaattagaaggcgaatttgccgaaatggatggctggaacgcagagtcggaagcggaccagttgttacaaaaccttggtatcgatgaatcgatgcaacacttgaagatgagcgagttaactgaaccgcaaaaggtgaaagtcttattaggtcaagcgctgtttggaagccccgacgtgctattactggatgaaccgacgaacgggttggacgtccaatcaattagctggttggaagactttttggctggttacgaaaagacagtcattgtcgtttctcatgaccggcattttctaaatcaagtttgtacccacatgtgtgatgtcgactttggcaagatcacactatttgttgggaattatgatttttggatggaatctagccagttagcggccaagttgcaagcgaatgccaatgccaagaaagctgaccaaattaaagagttgcaagaattcgtggcgcgattcagtgccaatgcttcgaaatctaagcaagccacctcacggaagaaacaattggagaaaattacgttggatgatatcaaaccatcatcacgtaaatatccgttcattaagttcacgccagaccgtgaaatcggtaatgaccttgtgaaggtcgagaatgtctccaagtcgattgaaggcgttaagattcttgataacattagcttcacgctccgtcccaatgaaaaaacggcgttgatcagccgcaacgatttggcaacgacaacactgatgcaaattattgctgggtcgatggcaccagatagtggcacggtgacctggggacaaacgacttcgcggacttatttgcctaaagatattaatgaagaatacgcgggtagtgaattgccaattattgattggttacgtcagtttgcatcgaaagaagaaagtgacaatactttcttgcgaggtttcctgggtaaaatgttgttctctggtagcgatgttgaacgaccagtgaacgtgctatctggtggtgaaaaagtacggggaatgttatcaaagatgatgcttagtcgggctaacgtcttattattagatgatccgaccaaccatttggacctggaatccattaccgcactgaatgatagtctgattgattttaaaggcgccatcgtctttacttctcatgaccatgaatttattcaaacgattgccgaccacattgtcgaagtgagtgcgaaaggcgttgttgatcgtggtgatacgacttatgatgaatacttggcccatgaagcaacacagggccgggtgcaagatctttattagttagtcgtggaatccgataaatctaaacaaaatcacgtgtgagcgtcccccaatctggtatgattaatgcatatcagattgggggattttttatgacgccagaaaccgaacaattattacgacgctggtacatggggcagctcatcgtgttatttggcgcggcctttattcaactatttacgtttgatggtggtgtgtttttcccagttggtggtatgcaattgctgatatggggactgctagcatggtggccagctgccgaggaggatcaagcacagtggtggcgtttgcgacatgttaattattatgtccaaacagtactgcagttcacactcttgccgattttactggcgaacctcgtggcttggttaagtcagctgtcatggttagatgagcagggattgattgctgtggggatggcttatttaatggtcgcattcgtgccggtggcagtggtggtcactaaaccgatcgaatctgtgattggccggattgcggtcctaattacggctatttttagtggcgtcgtcagtgcgcagcagacttttctgattttaccgaatctgcaagcaccatcagtgttcgagatggtcagtgatactggtattttaggcgccctgggctttgtgattgctgttggggtcttactgcggggatggggattgacgggcccatcgtggcggtttaatcgtcaggctcaaactagtttagtggttgggctgatcgtggtgggaacggcttttagtctatggaatgcctttagtgcaggtggttcatggacgacgaccttcacacattgggacttccagctacggtcagcgacttggaaaatgtttttgagtgggttagaaccgggaatcgcggaggaatggttgtatcgttttgccgttttaaccttgttattacaagcttttcggcatcggcgttaccagatcgactgggcagtgtggctaagcggtggcctatttggaatgtggcatattacaaacgtttttgcgggccaacccttgtcagccacggttgagcaaatcatttttgcagcgacactaggctggtttttagcctcgatgtacctatactcaggtagtatcttgctgccgatggtgatccatgctgctattgatattttgagcatgatggcatcaggtagccagacaatggttaagccggatgtgttcgaatggcaaacaatcggtgctaccgtcattatttttgttggcataacgatttatttcttgaccggttctcggcgacaagttattcaagcacatgtcaatcaacggctttcagctcaataaaggccgactgttaagaccatagtgggcgactttgttcgttaaagataaactgggtgtccgtagccagagacgattaagcaataccaggctaacttttagttggtttagaccagttgtaacatttttgtaatcttcgtgttatctaaacgcaatgctggctcgctatactaaagacaaagttatgaagcaatacatacgctttgtcagcggatttaggttgggagccggatcgatttactttgtcaggacattgttaataagcaattattgatagtgataagtagctcagttagctgaatcataacgtttgacaagcatttatacctctcgggatgggctgggtccatgacgaggcacatacacaatggcaagcttggggtttgcaagtcgatcagagaaagggacggttggttaccggcccttttattgtggttaaaatttgcgagaattggatttaggaggacgaaatgagaacgctgcataaaacgttaacacggttattacaggcagacttgattccgattgcgcatgtttcatttaatgagatgtataccggctatagtcgccgctatgacaccgtagtttttgttaaagttttcagtccgaatcacgaacgtaaatttagaactgagcagcaagtgacagcgcaactcacagaccgggtcttagccagttttcaattagcaagtcgcgagtgggtgttggtgttgcgagattggcaactaactcctgtaccgacaactttgactccagcgctcgtttaccaaatgggtcaggtagtctccagatttcaccacgcaattcaacttccaacaaccgcagacctgatgccggtactggatttcgatgggatggccgcccgggttgagcggttaaagactagtccccattacgacgcgctggtgtccttattaccatactttctcgaccaccggacgatgattataaccgcactagcaccgcaaccagtcatgacactgcatggggacatgggtactcgtaactttcgctaccatcatggtcagcttgttctgattgattttgaacgagcccgtcacgggtacgccctcgaggactgtttgaaattcttttttgaagatcttcaacaatctgcaacgttgattcaagctttttgggctggttatgggacagacttacaaataccaccattagtgacacagtggttactgttacaatgtagtactgggatatttacgtacgttaatcagattactgacccccgatttgaagcggtaggaactgcgatgctggcacaggtgactttgccaaatcattgagagtggaacgaaataatttacatttgccagtagattattataattaacgaatcaataataatttggagatggcaatttgactcagtttgaaacggaacggttgatattacgaccaatgacagcggcggatcatgatgcgttagcggacatgctttttgattcgcaggttgtcgcttatttacgttaccgacgggttcagagtccggccgcgttcgagcaactgtttacgacgcactttttggcagacacgaccactgtttttggcattgaacgtcgccgtgatcatcaactgattgggttttatgagtttcatggtagtggtgcgactggtgaattgacgtacgctttaagcccagctgcgtgggggcacggttatgttgcggaagccggcaattgtttgatgcattatgggtttgaaacgctgaactatgagaccatcgaggctcactatgcgagtgccaaccctaattctggccgagtgatggctaagatgggcatgcaagcggctggagaactgcacacgtttaccagtgataaaggtgaagtgatccacgtcatgcggtacttactgaccaaagcaacctggcgccaacttagtgcttgacctgaaacgcgtttcagcagctatactaaaattgttgcgacagcttgcaacacacgcttaagacttatgaccaccattctttcagccagaatggtggtttttttgagctgtcgttgtcctaagtgagctaaagtcaaggacggccagcttcggttcgctggaaaaggggccgtttaatgtaagtttatatgtccacgaatgtgattgttgttagggtggtttttcgatatagtagacctatgaattgagagggcgtgatcaaatgacggcaacaattacaattcgaccgcttcagcgcgcagaattaacgacgctatggcaactaggttttagtgatccaaatgcggagtggacgcgctggaatggaccgtattttcatgaccaactaccgactcaaacagactttgagacaattattggcccccgtgattggttgattcgaccgcgtaactgggtcatcacacgggatggtgtgattgtcggcagtgttaattggcactttgtggatggttccctcaaacgctggttagaggtaggcatcattatctataatcaggagcattggggtgagcgtattgggcgcaccgcgttgactaaatggttgacccacttattccaagaggagacgactttgccgcacattggattgacaacgtggtcggggaatacgcggatgatgcggttagcggaagccgtgggattaaagcaggagactcggattccacaagttcgttattggcaagggcagtattatgactcggtcaagtatgggattataaggaatgactggcaagtacaaaaagattaaaagaaaacgtttgttccccttgtgaaagtacggtatgatagaaccgtacttaaaaaagacggggtgaaagagaatcatggtgaaattaatgcgacgcgttggcatagcgggtctcttgagtttgagcttactgttgggtggttgtagcttgttaacgtctggtacggatacgacgagttcgacgactagtcagcagtctgaatccagtcgtaatcaaacgaccagtacgactggtaatacgcaacaaacttacaaacaactggcaaaaatgacttatcaatcgggcagtgctgcggccatcaaagttaatagcggtaagagtacgctggcagcgagtcagtggaaaaattctaagattgattacggtaatttagattcattgaatcggacaaccacggacacggcttacttgagcaaggccaatttaggacggtctgaaggacggacggcgcaaacgtggagcccaactggctggcataatcaaccgcttaccgttaatggtaagcgggtctatccgcaaaatcgcgggcacttgattgcttacacgttatcctttaacttgacgtctaatgggcagtatcgcgctggtgaagatggtagcttagataacccgaaaaacttggcaactcagacggcctactcgaatcaaaaaacgatgcagatttatgaagatcaggtgcgtacggcgttagaacaaggtaaaaaagtcatttatcgtgtgacgacggttttccgtggcaacgaattgatgcctcgtggttactggtcgcaagcagtctcaaccgatggcagtgtcaatttcaacgtctatatttggaacgttgagcctggcgttagcttcgactatgctactggtcgtgggaaagcggattcgacgatgcaggttgctggggctgataaagtcagcagtagtcagaatacaagtacgagtcgctcgtctcaatcgacgaccactagtaagcaagtcgagcgcgagttggttaagtatggttacaaatatgtgaagaaggcgttgaattaagcggcaagacagtcatctaggtcagcataatgggcacggtcggctgttaaacgtcgttttttcatacaacaatttaatctaaatgtcctgttttacgacaaaaggttcaaagtaggactagcaaagtttcactgagcgattatactgtagttattcgagttacttaaccgccgttaatttgctgatgtttctgtcattattaacaagtaacgcgatgtcttaaatcatggggccttcccaaacacctatgattttccatacaacggctccggctcccaaccggacgttgctatcaatcgttttgattgctagtactaattacccttggagacgtctgactgcgtggtcaggcgtctttttttgtgtcaaatgcgacaaaaataataatttgtcgcgtttaccgacaaagtggatttaggtgttgcaaacggattcaaaaagctttatcattgatacattcgaacattagaatataagaatataggaggctaatcgcatggtcagtagtgaagaagcactgcaagaatttcgagaaacaattccgatctttgaagtcttagccgatgaacggcgtcaacaaatcatgattgaactttcgcaacacgcgcagggcatgactgttggtgaattaactgaacggatgcatatttcgcaaccggccgtttcgcatcaattgaagacgttaaaggaacgacactttgtcgcagttgaacatcaggggacccgtaactattatcgggtgacgtttgacgcgccactaacgcaagttgagcatttgattcacacgcttaaggcggacttggaattgaaaccgtacttgcactaaactgcatgaacaccagcaatcgttgcacggggatgcagcggtgtttttatggtaactatattcttctattcgaatataagaatttaaaaacggggtgatggtaatttcaattcgtacggagctggatttacagcgggcgatgtaccaattgttggagcaacgttcaatctcacaaattacggttgagcagatctgtaagcaagcatttatacatcgcagtagtttttatcgttattatacggataaatttgatttgctcaggcagatggtgatgcacacgttagatgaactattggctgctgagcgaactgatacggttggttcggcaattatgtcgacgtttatcggggcgcacacgcaagttttacgacatttattagtgacgaacaatgagggtgacaatacccgttctcaacaagtgatcaatgactgttttgtcacggtcgccgagacgggggcggatgatcgggtttttgcgatgattcgccagtcgcagcatcccgatttgacggcgtacttagtcagtggggtcgtcacaagtattgtccagtggctcaataacggtcatcgtgatggtcaggcggccagcacgcaggcgatgattcaggggacgcttgcgacggtgttttcacttgagcaacacacagtttaattatttgaaggaaggtttcaggttgtgaaaatgatacgcgacgaatggcggtcaattcgtcatagcaaaatactatggatctcagtttcagtcatgattttgatcccgtttttatacagcatcttcttcttgaagtcggtgtgggatccatacggggatacgcaaaacttaccagtggctgtcgttaatgaagataagtcagtgaactatcaaggcgaaaagtttgcagttggtaagcaagtcgtgacgaatttaaagaaaaataacgatttagattggcactttgtgtcggctaaaaaagccaagcagggattgaaagaccggaaatattacacggtcgtcacgattcctagcaatttctcaaaaaatgctacaacgatgacggataccaatccgaaaaagatgaacttgcattatgagaccaacgaatcgttgaattatattgctaaagtcattaccgatactggtgtttcacgagttaataagagtattcgggcgcaagtcactaaggcctacgcattagcaattttcaagcagattcggactgccggtaagggctatcaaaaagccgccgatggggctaccaagcttaaagatggtggcgttgaactgcaggatggcttgacgacgtatacgacgggtgttcatacgttgaagaacgggacggtcgagctgaatacgaaagtgcagcaattacctgctgggattgctaagcttgctgatggtggtagtgcgttgaagaccggtttggatacgttgaatagtaagaccggggcgttagccagtggtgttagtcagctacaggatggttccgggcaagttactagtggacttggaacgttgaacggtaagactggggcgttagctagtggcgtcagtcagttgactgatggttctggacaggttactaatgggcttggaacattgaatggtaagactggtgcgttggctagtggtgtcagtcagttgacagatggttctagtcaagtcacaactgggctgactacgttgcaaggaaaagtcgtcccaatggtgagtggtgtcagtcaattgacaaacggctcagctcaagtttctaatggtctacaacaacttgactcaaaattaccgacaatgcagattggatcgcagtcgattaccgaaggattgttaacattaggcaataaagccgggacattggctggtgctgttaatttgttgacagatggttcaggcgaggtcacgactggattaaagaatttgaatgacaaaaccgggacaatcagtaatgtaactggacagttagcatatggatcccaaagggtcaaagtcggagttgccacatatactgatggcgtttatcagctgacgactggtttaactaaattagatggtaaaactggaaaattgtctagtagtgtttcgcagctttctgatggctcaacagaattggctagcggagttgcagattatacagcgggtgttggtaccgccaatgatggtgccagcctattgaaatcaaatactactaatttgagcagttctgtcaacgatttaacaaccggtgcgcaaacagtcaatgcgggtgttagtgatttacaaacaaacagtgcgaaaatttctgatggtctggatcagttgtcagccgcagtaaatgattcagcgactaagacaaaaatcgaaactttgaagactgaaatggcacaatttgaacaggcattggcagctagtcaaaaagaaattgctgctaacacgaagagtagtaataataacgatgctttaaatagcgcgttaaaatccttatcaagtaacgtggatgctttaagtatttccaagtcgccaacgcaagctgatattacgtcacaaatcaatagtaaaatcgatggtttaaagtcgtcacagaatttaactgatactcaggttgcggcaattaaggaaagtctaaaagatgttggacaaagcacgacgacgactactaatgcgcaacaagttcaaaatttgcagagcagcttatcaaaggtagagtcattagttgcggagaacacctcggcaacaagtaattctaatgctggcttagtaacggagtacggaaagattgaagctgggatgaataccattatttcagacattagttccacgacttcaggaattagtcaaattgccagtggctcagcagaattaaccactgggctgaagaagctgcaaagtgggactgatggtttaagcaatggattgacagaattaaatatgaaagtccctggattagttagtgggattgagtcgttatcaacaggtacaagtaaattggcttcacagtcagctcagctgaataaaggtgctaataatttgagtactggactcaccacacttaatggcgcggttcccgaaattacgggcgcaataggccaattgagtaatggtagccagcaattgaatgctaattcaaatgatctgaaccaaggtaccacacaactggcgactggtgctgcgcaactgaatggtgggattccaacattggtttcaggtgtcgagcagttgtttagtggttcccaaacggtcacgggtggattgaagacagtcaatggcagtgttcccgcaatgattaccggtataaataaattgagtactggttctcaaaccctcactaatggtattaacacagcacaagggggagttagtcaattactggttggttctaacaaaattacgactgggttggtaactatgaatggtcaactccctgagttagttagtggtgtccaacagttgcaagttggctctggcaaggtaacaaccggcttagttacccttaatggtcaagtaccggttctgtctagtggtgttcaacaactctttgctggttcaagtaaagttacaagtggcttagtaacattgaatggtcaagtaccagttctagtaagtggtgtccaacaattatatgttggctctagtaaggtcacaaatggtttagtaacgttaaacggtcaagtaccagtcctagtaagtggtgtccaacaacttgacaccggtgccggtcaactaaacagtggtttacaaaccttacaaggtagtaccggtcaattaacgagtggtgtcagtcaactaaatgacggtgccacccagcttgacaacaactctgccaaactcctatccgggacaaagcagattaagaacggtaacaagacactcgcgacttccttacaagaaggtgcggatcaagttaacgcaacaccattaaagaacgcgaatgcaaaaatgatggcggcgccaactaagacgtcctataaagactacacgcacgtgccaaactatggtcatgcgttagcaccttacgtcttgtcactggctttgtatgttggggcaatcgtcttcaacttcgcttatccaattcgacggattgcggatgacgacggcacgccaacacaatggttctggagtaaagttgctgttggtggtcccgtagcacttgcgatggcggtcatcgaagcgacagtgttattagttgctggtttgaaaccaatcagtgtacctgaatactacttgacggcaatcatgattgccttagcgtcaatgttcctagtcatgttcttatcgatgctattcgataacccaggacggttcgtcgcaatggttatcttgatgctacaacttggtggttctggtgggaccttcccaatggaaattaccaacaagttcttcaacgttattcacccatacttgccattaacgtactcgattcaagcgttccggcaagccttaactggtggttggggtagtggtatcttctggtcatcaatcgttgtcttagcaggaattacgattgtgtcgctgggcttactgtgggcttccatggtcttcctcaagcaacacgatatgcaagtcccagccgaggctgaaattcagatgaaagctggtaagtaattactggtaatcatattatcgcgcttccaagacgaaaagccgcgtcttgggggcgcggtttttatttggatttaagatacttctggtaagttcagctgatgtcgaaaaaagtacacatcgaatttttagcaactgcattatggactaatgcaaaagcactcatggtcaaataatgccgccatcaagtttgtgatcattgtagcattggacatctccttagatctgttttgcccaatatgttaaagctaaatatctgaaaaaatagatgacatatgattatcctatgctatcatataaggacaaagtataataccggtaaaaattggggaacgtattatgaaaaggggtagtttaactgtgttacgtgcactatcgttatcggctgtagggctgattgtgtcaatttttttccatgttgtaaatgccaactcgagtacttttacagagcaaagcgttacaactgaacaaaacgtgatttatgacaaagatggcaatcaggttccgctatttgatgcatcatctcaagaaccagttatcgaagaccggggcccgaaacaaccaacagccgtcaagcgattgggtaaagggcaatcttgccaagtaaataaattttctggttcaagaatacgctatggcagatatatgggtggtgtaactggaaacgctaagaacgttagcttttcagaaaaaaagggtgcttttacagggtacattactgatcgtcctgatctaagcactgtggcacagtattttacagcaactccaagtggcggtccttaccacgccgccttccatggtcttctttactttgaggctgacaatccagtacctggtccaaactattttatgcaagttcactaaaaccgtaataatttgcccgcaacggtataaagccgactatgcagtcagctttatgtatttatccaatacgcgttgtgctagttactttgtcatgaaacaattatgacagctgactttttccggttgttatctgaaagtattaaaatcggtgctaatgtcttgccagtggctaagcctaagtttgacgatttgctgaatgactagaataacctatctagaaaataatagtcgattgctgcattcggagttgttcaggtgttaaaaaggtaactgccaaaacgaaaatgttgtgtggttggtattagtgaagttaggcgttagttggtaaatggttttttatatggtacaagaaaggctcgggtacgctaacccgggcctttttggtatagtttcaaagtattaaagaattaatttccaaaaatgcagcaatcaatccacttgcaagactaacgttgctaccagtcaatcctagttttgccctgcttcaagtcgtttaacatgcaaaacactaaccaaaatggcgatcgccaacacgaataatagcaagaaatccaacttgctccccataatcgttccagttacggtggaatgatgaatttcatagccggcaattacagcggacataatactggtcccgattgaaccggcgtactgttgcatcatactgaacatcgagttttgatcggatttttgaggcagagggacgcgggtgctaccatccgaaatcgcggttccaaaaccggtattaaagccgacgcgtagtagcgcgtaaatgacagccatgatgatgactgtgaagtaatcggttgtcagccagaataatagtaaggcggcgctcgccatgatggcactaaatgttaataaggtcgttgggccttgtttatcgtaaattcgaccggcgattggcccagtgatggcgccgacgattgcgccgggaagcatcatgagccccgccgtcatggccgaagccccaaggacggtttgggcgaaaagtggcagaacgaacgacaacccgatattaatgaattgtaaaccaaagtaattaaatagccgaagtcgcaagattggcaatttgagaattgaataatcaatcagttggcgacgccccttgatggcgtacgtcaccattgcaccaatcatcacgatgctccacagacaccagaggccgaagttcggcgacagccagccgtgagttcccgcgttgttaaacgtgaacaacagactagtgaaggtgatggctaaaaggattgcgcccagatagtcgaattttttatcgccaacacctaaggccttccccgaaatgttgaacgcccctaagattgccagtaatgccaataacggtacgataccaacgaaaattgcccgccatgaccagacgctagttaaaatcccgccataagttggtccgagagccggggctagagacacgatgacactagctaaaccggtataagttcctagttgattgcgagggacgtaagtgaaaatcaactggaacatcagtggaatcgaaatcccagtggctacggcctgtaaaaggcggccagttaataatacggagaaattcggcgctaaccaacaaagaaggcccccaagcagacacacgagggcggcaaataagaataagggcttggggttaaaccgctttagaacataggccgtggtactcatgacaatggttgtcagtaataggtaaccggtcgtcagccactggacggtatctagtgaaaccctcattgttttaatcagcgtggggaacgtcacattcatcgatgtttccacgagaatcccgacaaatgagagtaaaccaacggataagattgccagtttggtttttaaagtgatggtacttggttgggacacaatcaacactccttataaaaataattggcgtattttggacagctcaccaagcccaatagtcggtggtaaaaatcagtaatctgaatttttacgattgaaagggacgatcgtaatgaccgtcccactaacgtccccagtttaagcttattttcaatctggtgcaatcactttgcattcgggatggaacttatcattaaggggtttgcgcgaggtatggtattataaaaagttgtctaattaaattttaattaaattattggaggtgcgctgtgagtatatttttgaaattaggctggtattttcggcgtgaatggaagttgtacctcgcgggggtgcttggactagttttgactgccattatcggcattgtgccaccccggattattggggacgtcgttgatgggattaatcagcacagcttgacggcgcacacgctgacggtctatttagttattattggtgtggccgccgttggtcagtacctggcgcgttatttatggcggaatgccatctggggtggtgcagccggccttgaacgaacgctgcgggaacgactcttttggcattttatgaagatggatgcgacgttttatcagcaataccgtaccggggacttgatggctcatgcgaccaatgatctcacggcggttgaacgggtcgctggtggtggtattctccaatttgcggattccattattactggtgggacaacgctgattgcgatgatgacactaatcgactggcgactgacgctgattgcggtggtgcctttcccattattagcggtcgtgtcacggtatttgggtaaaaaaattcacgtcgcgtttcgtgcctcccaagctgccttttcgcgactgaataataaggcgcaggagagtatcagtggaatcaaagtgatcaaagcgctaggtcaggaaaaggccgatgttgctgattttaatcaacagattgatcagacgattaagatcaatcggcatgtcaacgtactcgactcgctatttgatcccgcgattaccatgattattgcgttatcttacggcgccacaattattttaggcgggttgtacgtgacccacggtgtcatcacaatcggtaacttggtctcgttcgtcacttatttgggaatgatggtctggccgatgtttgcggtcgggatgttattcaacacgatggaacggggaaacgcctcgtatgatcgggtcatggaattattgaatcagcaaagtgccattattgatgccaagcggggcattgaacagcgtccgcatggtgatattcagtatcaaatcaagcagttcaattatcccaacgatgcaggaaccagtctgagtaacgtgaactttactttgaaggcgggacaaacgctcggaattgtcgggcgggttggtgctggtaaatcaacgattatgaaactgattttgcgtgaatttgatcagtacgagggccacattacttatggtggtcacgatattaagcagtatgcgcttgatagttacttaccagcccttggttatgtgccccaagatagttttctgttctcaaatacgattcgcgaaaatattcgttttgccgatccgactgtgagtcaagccgttgtggaagcggtcgccgccaagagtgatttgagtggtcagattgccagcatgcccgctggttacgatacccaagttggtgaggaaggtatctcgctatctggagggcaacgccaacgactagccattgcgcgggccttactcatcaatcctgaattgctgatcttagatgatgcgttatccgcggttgatgccgaaactgaggcagaaattttagctaatctaaaggcagaacgagcagacaaaacgacgattatcgtggcccaccggttaagttcggtgatgaacgctgatgaaatcattgtgttggatgccggtcacgttgttgaacgagggacccacgcgcaattaatgacgcaacacgggtggtatcagaagatgtttacgcgccaacaattggagaccaaagtggaaggagcggtgcaataatggcagcacgtcaatcggtatgggcacgttccatgcctgttaaggaacaactcacggttattcggcgactattgccgtatgcgaaaccgttcaaatggttttttattgcggccatcgttttttccggtctgattagtgtggttaatatctatctaccgcgtgtattacagacctttattgatcattatctcaaaacaggacacgccacggtaccggtcatgtggtactttgcgggcctgtatttcttcggcatggttgtgcgcgcgttgatgcagttcgtacagaacttcagtagtacgatgggggcagaatatatgcttgaaaatgtccgccgacaaatgttcgccaagttgcatcggatgggcatgcgctactttgatcaagtccctggtggctcaattttgtcacgcctgactaacgatacgatgtcgttttccaatttttgggcgttgtttaatacattatttaccgccttttttgcggtgatttcgtcgtttgtcgcgatgtatctcaccgatgcgcagattgccttgtggttattggttttcatgccttttttggctgtaacgatttggtattatcaacggtatagctcacgggtttaccggcgaatgcgggaacggctcagtgagttgaataccaagttgagtgaagcaattactggaattagtgttattcagcaatttcgacaagaacaccgcatcaatggtgaatttgatcataccaatgatgcctattttaagacccgccaagcgatgatccggacgaactcattattattaagtccactgatcgacttgttttatgcgttagggacggtcatggttctgggaatcttcggggttcgtggactcaatggttatgtggctgccggggtcgtttacgcgttcatcacgtacctgaataacttctataatccgatgacgtcgatgatggataatttgtcagactttcaagatggcgtcgtcgccggatcacgggttttacgggtcatggatgatccaacgattgtcccggcccaacacgccgatcctacggctaagattacgcgcggtaagattgaatttcggcacgtcacctttgcctatgacggccagcatccggtcttaaaagacgtttcattcgtggctgaaccaggccaaacggtggcactagttggtcagacggggagtggaaaaacgtcgacgattaatgttttgatgcggttttatgagtttcagtcaggagaagttttaattgatgatcgcgacattcgtgagtatccggctgaggaattgcgacagaagatggggttggtcttgcaagaaccgtttatgttttatggtgatattaattccaacatccgaatgtttaacgatcagatttcagatgaacaagttcaagcagcggcacggtttgtaaaggccgatgacttcatcaacgatttacctgagaattatcagtcacgcgtcattgagcgcggggccagttattcttcaggacagcggcaattgatttcatttgcgcggacgattgtgactgaccctaagattttaatcttggacgaagccacggcgaacgtcgatactgagaccgaagagatgattcagactggtttggatcggattcaggagaaccgcacgacgattgcgattgcccaccgcttgtccacgattcaaaatgctgatttgatcctggtcttaaatcaggggcaaatcgttgaacgcggttccaacgacgagctattgcaacagcatggttactactatgatatgattcagttgcaaaattccgctcacgtcgattaaagtgtggtatgctcgatttaaattaattgaggtgatgccgaatgcgtcgaaaattatcgttaatggtcgtgatgactgttattagtacgctggttaaagtgggctggcaattaatcttagcgcgccatcaagcgcctaaaaagttaaaaattaaggtaaaactgaaataaacattgtcgtcgtgtcggtagcgatgcttacggcgattcaatcagttgtcatgaccgaccgttctggaaaaggtgtaacttctagaatggtcggttttgtgttgaaaaattgagttggcggaggtgatcgcggtgagttgtggtggtgccccaaaaaccggtttatcagtggttcgtccttaaaatcggtcggtgacactcactgcaggatgtggcctggtatggttgcaaacgtgctgttcatttttggcccaacacctggagtacggtgccacgcttggatgtcgccaggcacattgaaaataaaggtcggtgactaataacggtcattaattcctaaaacgactggatgacggataactatacggaatggttataattgattatttgaactaggtattttactctgccaacggatcgcgttttaataaagatggtaatgagttaacgaagggagttgtgatgcaatgcaatatcgacaattaggaacatccgatttaaaagtctcgtcgatcgcacttgggtgcatgggttttggtgcggggactggaacggcgcttaatcagcgctcgtgggcggttggtcaaacgcaggcgaaccaggtacttgatcgcgcgatatcactggggattaacttttttgatacggcgccggtctatcaagcgggtgcgagtgaacgtgtcttgggacaaggactaaagaaatttcagcgagatcaattggtactggcaaccaagtttacgaatcggacaacccaagaaatcgaaaatcatgtcagtgggcgtgaacatgtcttgcggtccctcgaccagagtctacagaatttacagacagactatgttgatttatatatttatcatatctgggactggttaacaccaatggctgaaatcatggctgggcttaatgaagctgttcaggccggtaaggttcgttacattgggatttctaacgcctattcctggcagattgcgcagatcaatgcgctagcggttcgttatggttatccacaatttgtctcgatccagagtcattataatttggtctatcgcgaggatgaacgggaactgttcagttatgctcatgagaacgatttggcaacgacgccgtatagtccattagctagtggccggttggcacatccttttggcacccagactactcggcgacaacaggatacgtttgctgataccaaataccaagctaccagcgagatggataaaccaattattgatcgcgttgaggaactggcccaccaacatcatgtttcaatggcggccattaatttggcctggctacaacaacgagtaacggcgccgattattggggcaactaagccgcatcatttagatgcagtggctgaggcagcggggttggcgttaactgcttcggaaatacagtacttggaaaccccttaccgaccccatgacttggagggcgtgatggcacttaaccggtcacgaactaataattggaatcagtattccggacagtaagcgaacaagttagttgacttaacgtgcagttgaagtaatacactgatcctatcgtgcgactaaaggtccacgtttcagtataaaggagttattgagattaaattgaaaacaatcacacaacagtatttaacgggcgagcgggcactctttaaagctcacgaccttgaaatcgacaatacaacgtttgctgatggtgaatcaccactgaaggaaagtcgcaatgtcacgttgaaacagccaatctttaagtggaaatatcccttgtggtacagtcaacatgtgactgtggatcaaggtttgtttgagacaatgtctcgctctggcatctggtacaccaaggatattacgattacgaatagtacgctacaggcacctaagctatttcggcgggccagccaagttaagttagcgcacgttcacttttcagatgcggaagaaacgttatggaactgccaagatattacgttgaatgatgttcaagcagctggtgattattttggaatgaatagccagaatattcgcattgatggcttcaacctcgtcggtaattacgcctttgacggtgctaagaacgttgaaattcatcatgcaacgctgatgaccaaggatgcgctatggaattgtgaaaatgttaccgtttatgattcacaaatcattggtgaatacctgggctggaattcgaagaatattcggttcgtcaactgtacgattgagagcgatcagggcctgtgttacatggataatgttaagttggaaaactgtacgttactcaatacggacttagcttttgaatattgtcgtaacattgacgctgacgtggtttcaacgattgatagcgttaaaaatccgcttagtggtcggattcatgcgcaagccattggtgaaatcatcatggatgatcctgaagtagatcctcatcagaccctgattagtgttgaccatgaaagccgtgcgccccatgccgtttgattttgagaccgtacttaatcggcggcacacgaatgccgttaagtgggacgtcgcggataatgaattgccgatgtgggtcgctgacatggactttgaaacggcaccagttatcaagcaagcgttgataaaacgcgcccagtttggcgtcttcggttacgaagaagtccccacggcttactatgaagccgtggcagactggtgggcaacggaacacaacttccgtccgcaaattgagtggttgatgttctgcaccggcgtcgttccggcgatttcatcaattgttcgtaaaatgacagcgaccggcgataacgtgttagttcaggctccggtttataatatcttctatcattcaattgaaaacaatggccggcataccttgagtagtgacttagtggcacgtgacgcgtcgtacgcgattgattgggacgatttgacgacgaaactagctgatccgttgaccacgatgatgattttgtgcaatccgcagaatccgatcggcatcgtctggtcgcgtgcgacgttgcaacgccttggcgagctgtgcttgaaataccatgtgctagtcgttgccgatgagattcattgtgacttgacccttaacggtcacacgtacaccccattttcatcattgactgcgccagtagcacataacagtatcagctgtatctcaccaagcaaaactttcaacgtggcagccttacacgcggcaacgttgattattcccgatgcacacgtccgcgcattagtgagccggggtatcaacaatgatgaattggctgaacccaattcatttgcgattccagccagcattgcggcctatactgaaggccatgactgggtagccgtattgcgaaccaaactagctgccaatcaacgtcaagttcagacttacttgaccgctgaattgccgcaagtcaagttggtggaagcccaggcgacgtatctattatggttggatgtgagtcaagtgacaaccgacagtgccgctttggccgcttttattcgccaacgaaccgggttgtttttatcagcgggcgatgtttaccgtggtgatggcaaccgcttcttgcgactgaatgtggcttgtccaacgactaccctgacggatggattggcacgattaaaagctggtattacggcttaccaacaagttcaagcatagttgacgcgtatggggtgcaattccataatgatttcgctatcattaagataagctggtttggtctagatgaccgctgacagtccgtgataacggaccagataagttggttaattcaaaccattattaaaagatgaggtggaggatagttatggaaattggaattattggtgccggtacggtcggcacagtattagccaagacctttgcgcgcggtgatcatcaaatcaaattaagtcggcacagtggtgcggctagtttagcaacacggcgcgccgagtttgctgccaatgtggcttttgtagaagttgctgaagccttacaacaaccgttagtcattcttgcggtgccgtttgaacaggcgccgacggtattagcacaggtcgccgattatcagcaacggatcgtggtggacgtgacgaaccagtttacggccgactttaagaaaattaagacggccccgttgactgggagtgaagtcattgctcgcgcggcgaacaatgcccgggtcattaaggccttcaatacgattccaccagagtttatggatgggcacgttgatgggcctggaaagcgggtcttgttctatgcgggcgatgacgtggctgccaagaaagaattcgctgcgctcgtccggccgttgaattttcgccccgttaacttgggcaagcttcggcatggcggcagtgtcatgcaagttggcggtggactaggtaacacacactttgttcagattgaagaatagtggattgtaaaaaggggttcacttttggaccaaaatagttagtgctgaccttgtaagaaaaggtgtggctagtgtcactttgattgggccgtgcggtgggcatcaattgacaggtgttcctgccaatcgatgccgcgtggttaaatttgaatcgtgttatgggtcatgaagcctgattcttactgtgtcgtaactgtaagaatggggctgcatggctttttttaattgaggttaattattgtttatacggtttgatgaggacaatggtattgatacgagtctagtcaatcaaatcagcccacttagctacggaaatatccgataggcacaataagaaggacgtgaaaattcttatgtctttacgttattttggttaaataaaagtgtgaacattacctgctttatatcgtatgagatgcagtgtgcccattcaatagactttgcagattacgttaatgaatttcaactatacgcacaatacatattattatatttagccacgggtgttcttagttcccagctacctatatactagatcaagcaatgatactttcaactattatcgaaatttattggaataatgcaggttttccacttacagcgcctgaatttaatctccgctgtcaaagcaggtgcatgggcaataacccttgtctgacctgatgaatcataatagtgttattcttcaggcgtataatcatttattttctaataccaaaagcgttgtgcttcatttcaatgagaaatctagacacaacgtttttcattaaatactgctatctaagctaagatacttaggtgacttcagaaaggattttctaaattaatgtcttcatattcgaatgagttgctcatgctgattttccaatcgacgctattcaaacaagttatcatacttttcgcttatggttgcttgtactatttggtaactcattttatagataaaaaaattcagcataaaaaaaatttcttattgaaattaggcctagttaaactcaaaaaaagaaataagacaaggtgggaaaaaatacgattgataatgcaactgttcttactggcatcgataccggtcttagtctttagtgaactcgtgctaaatactgattaccagtacatgcttttggtttcttctattatgaagtgtgttggtttcatttcttttgtaattgcgtttgtggatagtttaggcccaataaaggagatgcagcagttgattgctggcgcacaaagcagtgatactttagacagtgataaaaaggcgctagcggtgacgagctttaaaaaaattagatggatgctgatattatatcaggtattaaaagtacccttgcttgtaatttttttgagcttaagtgttgattaccggcgcgacggcttcttttcataaaaatttgaatataactcatttttaatcccgttcctttagctattcttctcgcacgttaattgatagcaatcgtcaagtggattaaatctgaaaatcttatcacctgagaagaaagggcacgttttgacagattacccagatgaactgttattagcattgtttcacggccgaatcttgaattaagcaacgacgactgttttatataaattgcttttcttactgattcgccaattggtctttttgttgattggaaatcaaggtaaacaggttattgagttaaaagccgtcaacacaactactccgcataggacctaatatgttaaatagttcagtttttaagatacgttaggcctgcgcgcagagtttgctgattgtttttgcgtttaagctgttaataacagtttttgcagttgcttaaagttatccacagtgtaagttggggcaattgttgtgtcgttatgcgcatgctgtggattgtaccagatactaggtaactggacggtggccgctcccgcgatgtctgaacgcaggctatcaccaatcatgacggtattcgtggcattcatgtctgggtattggtcatgaatagcgctgaaaaagtgtgggttcggcttggcataaccgatactttcagagatgaagatatgatcaaaatagggcgtcatatgggcacctgccaagcgactgagctgggtgtgtttgataccgttagtgccgacgagtaaggtcagcccagcgttggtcagcgtgcgcaaaagttcgtgggcgccgggaattacctgataactgtgcgctaataattggtcgtattcttgttgaaccgcaggaccgtcaacggtgatgcccagtgtgcctagaaagacttgaaatcgttggtctaacaagctatcacgatcggcaccttgttcgatttgttgccaaacagtttcgttataggcctgatactcattttctgcacggcgaatatcagtgacgccatgatgctgaaagacggctgcgaggttagccgcttcagcgcggtcaaagtcaaggatggtattatcgagatcaaaaattgcgtattgcatggaaccactactttcaataggtttatttaaaccatcatacagcaattttgaatggtgtggtatgcttaaagtatcatacttaaaaggaagttaaacatggaaattgataatgacccagcgtatcaacaaatgattaatggtgaattgtacttagaatcaccaatcctacagcaacgtcggcgagacgtgcggacgaagttaatgcaatataatcagattgctgataatgatgaacggaatactaagatgaaaagtctcttacgttcagccggtgaccggttcttcgttgaaccgacctttgaatttagttatggcgtcaatattcgtatcggcaatcatttttatgctaaccatggggtcacgttatgtgatgaaggacttattacgattggtaatgattgcaaatttggtcctaaagttggcttgtacacgcctgctcatccattagacccaactgtgcggcggactgaagcggaacggactgcaccgattacgattggtaatgatgtttggattggtggtagtgccgtgatcttacccggggtgacgttgggcaacaacgtgattgttggtgccggtgctgtcgtaacacattcatttccagataacgtcatcgtagtcggtaatccggcgcgtgtcttgaaacaaaatgcaccgcagtcataattgacaattacgcctaaattgatgaaaataagggtgtagtcagattatcagagaatggggagtggagccatatgtcagagatgagtcctaaggaatttaagcacatcttagtcggggttgatgattcggatgacgcgcagttagcgtttcggtacgccattaaccgggccaagagtgacggtgctaagttaaccatcgtctcgattttggaacaggataatatgaatgtgtatgaagcgatgagcaaggactttgttcatggtcaacgcaaggatttggaagaacacgttcagcagtatcagaagttggcccgtgacttcggggtgacggatgttaacgcggtcgttgatgaaggtgaccctggtgaaaccatcgtgaagacggtgattccagcgttaaagcccgacttactagtcattggctcagttgccaagcatggtgttcgtaagtacttcggttcgcaagccgcatatatggcaaaacatgcaccgatttcagtactggtgattcgatagtgataagatgaattttgattgatcaggccttccggttatggagggctttttttgttgtgtcttgaggaataccaaataccagtggtaggggctttatagttagacaaatatatttaagttatggctgaaagttgtcttttcattcagctttaagaggtgtttcagggtgacggtataagtatgccataggtaatcgagtgaaatactatacgaaaaacgtatggtagcatgtttattcggtatttttcagtgaataagaatcggtttatgatagtgtcattcaatcagttggacaagtaggttacataagctcattagactgattagagaaatatttaataatcacggaggatttatttatgaaagtcttgattttaggcgcagcaggtcaaattggtcaaatggtaactggtgatttgttggcacaaacagatgacaacttagtgctattcggtcataacgtctcacaacggttggcggaacttgattcagcaagagtgacgtttgttgatggtgattttttggaatttgacaaggtacgacaagctgccgaaggtgttgatgcggtatatttaagttttgttgctaagccagctattattacgggagtcattgacgcattagataaggccggggtaaagaggtttatcgtagctaatgttcctgatttgtatcaagaagttagtgggccattccaaacatggtatcggcaaaatactgggctgacatggcaaactgatctcaaaaagtcggccgacttagtggaaaatagtgatttggattacgttattttacgtattacttggctgtacaaccaagtaaataatactaagattcatgtttccgagaaaggtgaacctttaacggaagcccaagtcacacgtcaagcggtcgctcaatttgttgttgatcttttgaccggcaaagctgattatcatcaagccaacttaggattgggtgaacctgatactcaattcactaagccgagctttatgtaagagacaaacctgtgaatgctcagaaagcatttgcaggtttgtcttttaccaaattagtactttaaagttaggagtttgtaatgagtaagagcaaagaaaaatttggcattgtattgccaattattttattaagttatttcatgattttattagataattccattatctttactagtacggtaaagattgcgcaagagctacatttaaattctcagacgttagcgtgggtaagcagtgcttatacgttaacatttggcggctttcagttatttggtggccgtatcggtgatgtttttggtcgtaagcgagtgttcttgattggtttggttttattctcatttggttcattaatggtggggctatcgaccaacgccgccatgattatctcaatgagggcatttcaaggcatcggctcagccattttagcaccaactactttggcactgttattggatagctatcaaggcacaatgcgcacgcgagcaattgcggcatacggtgcaactgctggcttgggtgctagctttggtctgattttgggtggcatcatcaccagcgtgttctcatggcggtacggttttttcttgaatgtgccagtgggaattctgatgtttgtcttgacgatattctttgtacatgacagtaagactgaaggttcacgacatctagactttgtggggacgctgttatcagttatcggtttatccgctttggtatacagcattgatggtaccagtcatcaaattttggccttgatcgttgcgattgttgctttgattctgtttgtttatgcggagaagcgcatcaagaatccaattatgccattgaaattatttatggatagagaacgtagcagtgcttacatcgcacgtttcttcttcatcggtgcggcatttgcctacttctttgtgacaccacaagctttgcagcgagtgtatggatttacaccattgatggctggactagcctttttaccagcgacattaccacaattcttcagtgcaacccaggtttctagagtttcaatgaagattggcaatgatcgtttgattctagtttctatcatatcaggaattattggtgtcctactttcagccgtgcttggtcttagtcatggatactggctagcagttggtattccaatgattttctttggtgttggacaagggcttggattaagcccgctgactatcgcgggagttgccaatacggatgctgatattgcgggcgccgcttcgggtgtcgtcaatacagttcatcaatttggacaatcggttggaatgtcaattgttgtcgccatgactagcggcttcaataatccagcgacaagctatcactatcaattgttgattattgctgtgatttttattttgagcttcattgcatcgcttggaattcagaggaaaaagcaataaaaagcattaccatacgtctgacgtatgctggcatgcttagatagtaattttcagcgagttaaatcgaccttataatgaattcatcaattaaataaagaggagatcacataatggaaacagttaaattaaataatggtgttgagatgcccaaattagggtttggtgtgtttcaagttacagatttagaccaatgtgaacaagcggttgttgatgcaattgattctggttaccgcttgattgacactgcggctgcctatcaaaacgaagcagcggtcggacgggcgattaaacggagcggggttgatcgtaaggaactcttcattacctctaaactttgggtttcagatgctaattatgaacgtgcacagaagggcattgagcaatcattaaataatctgggcttggattatttggatttgtacctactacaccagccatatggagatgttgtaggtgcttggcgcgcgttggaagaggcttacaaagctggtaaaatccgtgccatcggagtctctaacttctatggtgaccaattaaaaaacttggaattatcaaatgaagtcaaaccagcaatcaatcaaatcgaagttaatccatggtaccaacaaaaatcagaagttgacttcgcacaaagcgatgatattcaagtagaggcttgggcaccgtttgcagaaggtaagcacgaaattttcactaataaagttattgctgaaattgctaacaaatatggcaagtctaatggtcaagtgattcttagatggctacttcaacgaggaattgttgttattcctaaatcagtgcataagaatcgaatggcggaaaatattaatgtttttgattttgagttaaaaagtgacgaaatgaatgcgctgaataacttggacaaaggcgaaagtcagttttttgatcatcgtgatccaagagttattgaacaaatttttggagcaagtttggcacaattaaaataataaaggggtagataaatatgtcagaagcaacttttaaactaaataatggtgtgaagattccagaaatgggtattggtacttttcaaatgtcagttgatgatgctgagcaagctgtagttgacgctttgaaagctggttatcgcttggtggacactgctaatgcttatatgaacgaaactggtgtggggcgtggtattaaacgttccggcgttagtcgttcagatgtattcttgagtacgaagctttggccatctgtctatacagacaataatgcggttgatgatacgctgcaacgcttaggaactgactatgttgatttgatgtttttacaccaaccagctggtgactttctcactggataccatcaacttgaaaaagcttataaagatggcaaggtcaaggcaattggtatctcaaattttcaaggcgaaaaattacaacagttattggataatgttgaaattaaaccgcatgtgattcaagccgaagcacatccatactttactgaagatgaagttagaacaattttgaaaccgtttgggacaagattgatggcttggttcccattaggtcatggcgacaagagtctgattcaagaacccatttttgctgagctgggtcggaagtatcataaaacgagtgcgcaagttattttacgttggcacacacagatgggattcattgtgattcctggatcaactaatccggatcatattcgtgataatcatgacatctttgactttacactgactgatgaagaaatggctcaaattgctgctgtaaagaagaatattcggtattacacaccgtcagctgaaaatgaagaaaaatatgccacgatggcgttagactttagtactgaaaagtagactaggagtgttttattaatgagtgaatcgaaagtaatcgttattaccggtgcgtcaagtggtattggggaagcgacagctaaattagtggctaaagatggtgcaaaggttatcttgggagctcggcgcgagaataagttaaagaaaattgctgatgggattgagaagttaggtggcgaagctgcttatcaagcaaccgatgttactgatgataatcaggttgaagcactcgctaaattagcgatagataaatttggtcggattgacgtttggctgaataatgctggtattatgcctcaatcgatcctttctgaaaagaaaatcaatgattgtaacaatatgattgatatcaatatcaagggaacgctttacggtattggtgcagcgattccgtatatggataaacaaaaggcaggacacattatcaacgtttcttctgttgctggacacactgctcattcaggtagtgccgtctattcagcaaccaaatatgcagtctgcgctatcagtgaatcgctccgtcaagaaatggtagaagccaagaataatgttcgggtaacggttatctcaccgggtgctatcaacactgacttgctttcttctgtaactgatcctgaggttaaagctggtatggagaagttttatgaatcgtttggtatttcagttgatcgagtagcgttaacaattaaagaagctattgatatgcccgccgatgctgcttggaatgaagttattattcgaccaacaaaccaaatgggctagtccaaaaagactggaaaatttgagcgtactgcttaggtagctaactcctagttacctagtttgttaagtgataaatagcccctgaaccaatcgtttttggactggtttcaggggctgtttatattgattgtcggatttgtgacaacttacttttcggttgccaactgttattttgctgcaagaaaataaaactttaggccgctttaacattttgggggccattcgaacacgattcagattgagcgtggctatgtggaaatcgctggtggtgtcaagttgagaatttaagagttagccatttggcagttagttcgaatgagacttttctcttgccttggagttcacaccagggtttaacatgatgtttgttaaaaatcaagaaaggtatgattaagttgaaaagatggggaattggtattgtcgttgcaatcgtgattattgtgagcgtgatttgaattggatctactatgtccggtcattacgccaggccggaatgttgattgaatcattgattgagtatatgaaactacttcatcaaccggatacttcaccagaagtacgacgagacttactgatcgatcaacgtgatgaattagtgcaacagttgagagagacacgacaaacaattgcatatttgtcctataaaatcgatcatttccaagaacatattttaagcagtgaggcagcacaactatttccacaacaaagcaacaaaattattgatgatagtcacaacgctgaggactgatctattgcagtaccataatgatttaagataatccaatatatcctgaatggtaggaaatttttggatgagaggagtgattgaatgaaaaattcaagtaacgcattagtgttgtatttttcactcacggataatactaaacgggctgctaatacggttgctgagataacgggcgctgatattgagatacttcgtttagaagaaccttattcagacgattatactgaagctgctaaacgtgcggagcaggaaaaagaccagcaaataataccagaattaagaccacttaaccatcaattgaatgattatgagacgatttatttaggctttccgacttggtggtatcagccaccaatggtgattcatactttttttgctgaatatcaattttctggacaaacgattgtaccgttcactaccagtgctagtagttcaattacggcaagtgccaaagtattagcttcattgaccgaacgaaaaaacgttgatttaaaagcagggtttactgctaatcaaactaacgtgattaaacagtattttaaagacctgttataagttgagtattaatggataagctttgatttaaggggatgatgaaaataaaaaaggtcgggctaggattaattggtattggtagtttgatgttaattggcatctggttagtactcaaagctgagccgaagaacggggcatgggcaaatcaacaaaccgttgtcgccgttactcatgacaacattagggatagtggcaatagtgttgctgaatgtgtaacttctaattgatgtttatgaggttagtgtgtgtcgtagcaaacattagcggattgctaggttgcgtcgctggtatgacatgcgtatcggtaggattgaataattaatttacagaaacctagcgtgatggttgaatgtttaccatcacgctaggtttctgtaatagttacttactttgtagtgccttgggccactgttgttggatttcgctaagcatgggagctaggtgtttcttttgggcaatcaagtagttagcatatacgaccattttggcgctgtcatcactgattggaacagttacccggtccttatcgtttttaacctgctcattaaagaacgggtcgctttgcgataggttagtcgtgaagaatggaaaacgtgagtatttagtgatttcagcaaaagcgtcacggtcatcttgatacataaacttcgcctctggaatattatcttgaataattgcactccatgggccaatggcacgcatcacaatgaaactcataccttgcagttcctcaaaggttacggttggttgattggctaagtaagtaaattgatccaagttaacttgtagtcgttcttcaccaatgtattgagattcaatctcatccgtaaaaatctcctgatcagaaaaaatcacggtgtattggttattattgagtgcgtcagtaatttgctgattggaaatggcattagtgtcaatttggatatgcctgctaagcgtgggctgtagctcaccaaggaggattaatggacctggaacagtcgctgcaatcgcagttaagtgttgaccttgatcatagttctgcaccttcgtaatcatggccgtgttgagcttcagtagttttgtcgcttcttcagctgcaagaacgcctgtgggggtaagctgaatgtgattggcctggcgctcaaataactgaaccccaaactcgtcttccaatttttgcataccacgagtgacggaaggctgagtcacattcaactgtgttgcagtttttgttagtgtcccggtttgcgcgaagacgctaagttcttctaataaatagctttcaatcatataattcactcctaagcatacattaaacgtatggtagcatgtttatctagtaattttcaaacaatccatctcgccttatgatagtgtcattcaatcagaaaggtgtgaaacaaaatggtcatgacgcaaacggtccgactaagtagtgggattgaaatgccgcaagttggtttcggcgttttccaaattgtagatgaacaacaatgtgaacgtgcggtaacgcaggcgttacatgcgggttatctttcaattgacaccgcgacggcttatcagaatgaagttgcagtcgggcgtgcgataaaaaatagtgggattcgacgtgaatcactctttgttacttctaaactgtgggtggcggatgcgtcatacgaacgtgctaaagcaggcattcaggcttcgcttcagcacttgggactagattacttggacttatatttattacaccaaccttatggtgacgttgtgggtgcttggcgagcgttggaagaagctaatcaagcaggattaattcgggctatcggggtatcgaacttttctgctgatcaacttaaaaatctggaattaacgacgacaatcaaaccggtggtcaaccagattgaagtcaatccatggtatcaacaacaagaagccattgattttgcacagtctgaaggtattcaagttgaaacgtgggcaccatttgcggaaggtaaacaagcgatttttgaaaattcagtattagtcgccattggtcaacgatatggcaagactgctagtcaggttattttacgttggttattacaacgtgatattgtggtaatttccaagacgattcatgtggaacggatggttgcgaatctaaatgtttgtgattttgaacttactgacgaagatatgcaacggattacccaacttgatcaacatcgtagtcagttctttgatcatcatgatccgttaacaattgatcagatttttggcaccagtattcagaagagtcgcatgccatcagggcttgattagtatcgtttagcaggatagttgttaagaaacaaattgataaagtttattttgaattgaacggaggaattattaatgaaagtgatgattttaggtgcagcgggccaaattggtcaaatggtcacacagcagctgttggcgcaaaccgatgatcagttggtattgtatggacataatgtatcacaacgattgacagcgtttgattcgatacgagtgacatttgtggacggagattttcttgaatttgataaggttcaaaccgcattaaacggagtagacgcggtctatctgagctttgttgctggcccggatattattgccggtttgattaaggttttggatgcgacgggggttaaacgactcattgttgccagtattccagatctttatcaagaagtcagtggcccgtttcagcaatggtatcgtgaacgtaccggtatcgtttggcagtcagaccgtaaacaggcagctgatttgattgaagcaagtgacctcgactatgtgttgttacggattacgtggctgtataaccaaactggtaatacggcagttgcggtaactaagaagggtgaaccatttacttcggcccaagtgacgcggcaagctgtggcacaattcgtcgttaatttgttggctggtaaaggtgactatcatcgtgaaagcctaggcttaggagaaccgcagactgaattttcaaaaccaagtttttattaattaattggtgaacattgcttgcaatcagtgcgcaccacaaaattttaaaggaatgaaggaaagcataatgaatattgtttggatgttattacctgcgattgcgtggggcgtgttaccactaattgtgagccaattaggcgggcgaccagttaatcaaatttttggtacggccgttggaacattaattgctagtttagtcgttcagctaatcgttcacccagccattaacgtgatttcatttattatggccatgattgctggtgccttttggattattggtcagttgggacaatatacgggatacgccaatgtaggtgtttctaagacgatgccgatttcaactggattacagttagttgggacatcgttagttggtgttttcttgtttggtgaatggtcaacgacaattgcaaaacttgtgggcggcttaggggtcttgttacttgtgattggtgtcatcatgacttcaattcaagatcgccaagaagtgactggcagtaatcagcgacgaacgattgtgatgttgattgtgacgaccattggatttattgtctttaatgcgattccaaaggcgttatctgcgtctggtattgcgatctttttaccagaatcagtgggaatgatggtagccgttattgtttatatgttagtaagtggtcaaggtcgaattgtggcagaacgggctagttggttgaacattattggtgggttagttttttcagtagcttcgttgacatacattgtttcagttagccagaatggggtcaatacggcctttgtggtttcgcagttatccgttgtgttgtcaacattaggtggcatggtatttttacacgagcgtaaatccaaacgtgaattagttttaactttgagtggcttagtcttgattgtgatcggtgcagtcgtcactactttaatttaaactgaaacgtcatatgatcaacttgcgacggaataattgagctggtttctttacaaaagacgaactaatgaaaaattagccataaaatgagcggcgctaatgcaattttagtcccgttagtattatgatgtctgatcagtaatcagcggtgttcaagaatacctttattcttaagtaccgctgattttggttagtcgtgctagtggcattgattgacttcaagttagtatgttgaatgagcaagttatacttttaggaatgattgtggagttgtacctgtgtttagaaacgactaatcatcagtgatatatcactggtgtagcaatgttggcgtgtgtcactgaccgagctaaaggtcacacagttatgccatacgttaaacgaatgctagcatgtttatcaagtaattttcaaagtgtctttttagcattaatatatagacattcaatcggagcgataaatagcggcgcttcgtaaacaaatagttattgttaaaggagtgaagtaaaaatgtatgaagatttaaatggtaaggtagcagtcattacaggtggctctaaaggaattggttcggcaatcgccaaaagatttggtgaagaaaaaatgaaagtggtcattaattataatagtgatcccgccggtgcgcaaaaagcagctgatactgtaaaagtagctggtggtgacgctgttattgtccaagctaatattgcgagcgaagctggtgtggatgcattattagctgcggccattgaccatttcggtgacctagatgtttgggttaacaatgctggtatggaaattaagtcaccaactcatgaagtctcattggatgattggaataaggtgacggctattgatcagaccggtgtgttccttggttcacggacagcccttgcgtactttaaagcgcatcaaaagccaggcaatattatcaacatgtcatccgtacacgaacggattccttggccaacttttgcgagctatgcagctgctaaggggagtgtcaaactctttactcagacgattgctatggaatatgcgcaggacaatattcgtgtgaatgcaatcggccctggtgcaatcaacacaccaattaatgctgaaaagtttgccgatccacagcagtatgaccagaccgttaacatggtgccaatgaaccgaatcgggacgccagaagaggttgcagccggagctgcttggctggcctccagcgaatcaagttatgtcacgggaattactttatttattgatggcggtatgacactttatcctgcatttaaggatggtcaaggataattatcactagtgaataagtagtaatggtgacgttacatcggcagtactttgatttaattggaggtaagtagttaatggcgcttaaagaacgtatggacgttaagttagcatcagcagtaatggacaatcaaatcagtgatcagccagtagtggcttatcagttagggaaaacggccagtgtctggcaacatggtgcgggaactaaatctgatggaatggatacgaatgctagcaatcagcctactagacgattaacaaagcaggctcgaagcatcattatttatttttcacggtccggaagcactgaattgcttgctagccaaattgctaaagagactcaggctgatattttggagattgtggtcaaatcaccttatgaccgtaattatcagcaaacgttagcgcgtgctaattcggagcgcgaaactgctaattatccggaattgaatatgcaggttcctgatttgagccagtatcaaactatctatctgggttatcctgtatgggcgatgactttatcgcatccgatgactgcttttttaatccagtatggtagtcaacttcagcataagcagattgcaccgtttatgacagagggtggttatggtcagggggatagcgtggaacgtctcaaaggcatgttaaaagtcgacggttcgagtactaaccgatatgagacagctctagtcattgacggtaataaagttgatcgtgaagttaaacagatcaatcaatggatacaccgtgttacgcaacgtgactgacagtcattggcgtgacttggtaagtcacttttagttagcttaatgtaatgctgaattataattaagttaattaataaattggaggatcttttaatgaataatgaacgactgaccgcatttgaagatgcgattctagctattattatgacaattttggttcttgacttgagtaaaccaaatcccgttagttggaccggattatgggcattgcatgcgagctttttcgcctatgcgctgtcgtttttctggattggattaatgtggatgtcacatcataatagttggcaagcagttcggacaattaatatgacaaccgtgctcttaacgctagtgttgttgtttttcgcatcgttattcccatacacaacgagcctggttgcgaacagttttgataatgcgactgcccaagcgctttatgggattattattattgcgatttcgttattgaacgttggtctatcgctgaatctaggtcgtctcaatccacgcgccaaatttggattgttatataagacgccaacgtgggtcgtattgctcgatctaggaattaaattgattgggctaattttagcaatcactatttatccacaagcgatgatctattccatttttattgcgggtttggtgctgagcattagcatgacgactaatcgccaagttaaattaaactaaggggcgctattaatgaaaacaattaagttaaacaatggtgttgaagtaccgatattaggatttgggacattccaaattactgatcctgaagaagctgaagatgcggtgcgtgatgcgattcaagccggttatcggcatattgatacggcacaaagttatgaaaatgaaggggccgtgggtcgtggtattgcaacctcgggtgttgaccgcaaggaattgtttgtgacgactaagatttgggttgaaaatactagttataaaggtgtcatgagctcgtttcaacgttcacttgatcggttaggcttaaagtacgtggatttattactgttgcatcaaccatacaacgatacctttggggcttggcgtgcattggaagaattacaaaaacagggtaaagttcgtgcaatcggtatttctaactttagtgttgaacaggcggtgaacttggctgaatttaatgacgttacaccacaaattaatcaaatcgaaatcaatccgttccaacaacagacgaataatattcaagctttacgtgatgaaggcatttccttggaagcttgggccccattcgcagaaggtaagaatgatattttcaacaatccggtattaactaagattggggacaaatatggtaaatccgttgcgcaagttattctacgctggctgattgaacaagatattgttgtcttagctaagtcggttaaaccagaacggatgcgtcaaaatttggacgtctttgattttgaattaaccgatgacgacaaagcacaaattgcgactcttaatgatggcgaaagccagttcttctcacatgctgatcctaaaatgatcaagtggatggcaggtcgccgtttggaagtgtaatgattaatacattgaccgataattgactacagtttagaaaacattaaaccaaaacacccgtcccttgtttttgagtgacgggtgttttcattgataagtaaaacttatcaatgtgggctgaatttgaaattggtctaaaagacgtttgcttgtaagatatgacttgtaagttaaggtgaatcaaaacaagtaaagaggtcaatgaatatgaataacgaagtaattgtgcttttcggtgccggctcaattggtaaagcaattgttcgacgtgttgctgccggtagaaatttattgttggcagactataatgaagcaaaattagttgaaatgaaacaacacttgacggaagctggatttaacgttgagaccatccaagcggatctttcatcacgggaatctattaagacagtggtttctaaggcacaatcgcttggtaagattatgggattggtcaacgcggctggcgtttcaccatcccaagcgagcccagaacaagtgctcaaagtggacctttacgggactgccgtattgttagaagaatttggtcaagtcatggctcccggtagtgcgggaatcgtaatttcgtcgcaatcgggacaccgattacccgccttatcacaagcagataatcaagccctagccatgacaccgactgaagaattattggatttaccaattttacaaccggatgtgatcaaggattcattagcggcttatcaatatgcgaaaagaaccaatgttttacgggtcgctgctgaatcggttaagtggcaagctcgcagtgcacggatcaacacgatcagtcccggtattatcatgacaccattagccgttgacgaattgaacgggcctcgtggtgcgggatacaaaaagatgttcgagtcaatggttacgaaacgtccaggaacacctgatgaaattgccaatttggcggaactcttaatggatcgccgtggtgcctttatcacagggagtgatttcttggttgatggcggaattaccgcacaatattggtatggtaatgtttcagaagttcgtaacaatggcgtccagaaatagaattttaaggagagtttattatgaaagcagcaacttttattgaaccaggaaaagtcgaagttaaagaatacgacaaaccaactattcaaaagccaaccgatgcaattattcgggtgctccgggcctgtgtatgtgggtcggatttgtggtggttccgcgggatttcacaacgccaagcaggttcaaccgttggtcatgaagcaattggaattgttgaatctgttggttcagccgttaaagatgtacaagcaggcgatttcgtgattgcaccgttcacccatggttgtgggcactgtgccgcttgtttagccggttttgatggggattgcttaaaccaagaagccggcggtaacggtggctatcaaggtgaatacttacgctttaccaatgcaaactgggcgttagttaagattcctggacaacccgaagattattctgacgacatgctgaacaactttttagccttagctgacgtgatggcaacgggtttccacgccgcaactagcgcagaagtcaaaaaagatgataccgttgttgtgatgggtgatggtgccgttggtttgagcggggtgctttccgcaaaattgcttggcgctaagcggatcatcgcaatgagtcgccatgaagatcggcaaaagttagcaaaagcatttggcgccacggacattatcgctgaacgtggtgatgaagcagttgccaaagtgatggctttgaccgaaactggggctgacgcggtacttgaatgtgtaggtactgaacaatccgttgacacagcagttaaagtcggccgtcctggtgcggttgttggtcgcgttggggtcccacaaaaggctgaaatgaatactaataatcttttttggaagaacattggcttacgtggtgggattgctgctgtaacgacggatgacaagcaagttttgttagatgctgttttgacggggaaaattcagcccggccaagtctttacgaaacggtttatgttagatgatattcaagctgcgtacgaagcaatggaccaacggaatgcgattaagtcattggtcattgtcagtgataaataggagggaaacatgaagaaagttttaattgttggtgcaacggggactattggcggtgcagttcgacaaacgcttttgaatgaaaccgataatcagttaacgttgtttgctagaagtgccaatcgattaaagactagtgagcgtgaaagtgttatcgctggcgatgttactaaagatagtgacttagacaaggcgattgcaggacaagacgttgtttttgttgccttgagtggttctttaggtcgctttgcccaaaaaattgttgcggcaatggaccggaataaggtttcacgattgctgtttattacttcaatgggtatttatgatgaaattcccgcttcggttggtgctagtggaaatttaagtagtaatccagtgctacgcacttatcgggaagccgccgatgttgttgaagcttctgatttgaactacaccctgattcgtccgggctggtttactggtggtcctgttgattatgaaatcacgaaaaaaggcgaaccatttggtgggcatgatgtctcaatcaattcaattgcggattttgtcaagaatgcgattgtcgataatgattattatgcacatgatagtgttggactaaatgcaaaataatattcaaaaggtcattagctagatagctagtgacttttttcgtttataagcatggcagggaatcggttcaggttctgctgcaaaacatttctcaaattgttgattaaggttatactaattaaaataatatgacaaatttgaacattcaaagataattttgtaaaggttgaggtgccggtaatgtttcaacagatgcagtattttatcgcaatcgttaataatcatagttttactcaagcggccgtggactgccacatttcgcagtcagcgatttctcagcaaatgaaggagttggaaagtcaacttggtgtgaagttattgaatcggaaaggacgcagctttgaagttactgaagcgggtcagtacttttatattcatagtcaggatattttggcggatgtggaccaacttataaagaaaaccatcaaaattgaaaagaatgatgaggtcgagttgcgggttggctatttaagaagttttgggactgctgagtttttacaaactgtttcgaagtttactcaggagtttcctaaagtgaaaatcaaaattagtagtggcacgcacgaagaactctatgaattattacagacaggaaaaattgatttgaatttttctgatcaacggcgggccttatccaatgaatatcaaaatgaatttttgactgctagtgagtttatggttgccgttaacaattcgttgccagttgaggcacaaaaaatcgacgttgctgacttagtggatattccttgtattttgatcattgatggtcatcagcaagtctcagaagaggagtattatcgcaatgttttaggtgtcaaaagtgagtttgtgattgctaaaagctatgacgaggcacaaatgttgatcgcgtctaatcaggggtatttgatcatcaatcagcggatgagaacacaattagataaagatattgttaaaatgatttctttggtgaaaggggaccgaaaattgattcagaattattacgcttattggcaagctaataattcaggttattatatcgaaacttttgctgaattattgaaacaaacctttgcataatttttacttatgaatgacccttgatttctgaatggttttggcatagaaaagttggtatcatgcttgatgtaagtaaagaaagcgtggtaagaatgacggataaagaaataattattcaattgtatcgtgatgaaaatattgctatggttcagaaaaacctcagtcggttaaatgaaattttggcaccaactatgaagttaacccacatgatggggtatgtgcagtctaaattggagtggattgaccaaattcaaaatgaagaaatgcaatattttgcttcaaaagaagataccatcaaagctattcagattgaaggtaaccgggcaagtttaattggtcagaaccaagttcaggcaagaatttggggtgggggtacgcatacttggcggttgcagatgcagatgttttatgagaagaagaatggtgattgggtcattagtgcgcagaaagccagtacctactaaagcgactagtgattagtggtcagtaaaacggtcgcattaggaaaatagtatttgttggcttggctagactgtcaactaaaggcaacacgcctgtgctttgtgacaattcctgaatagaatatattaagcgaactataatacctttaatttctgatgactgtggcatataacaatgttcgatattatacatttaatgctactaatgaagagaaatacacaatgatggtgttaagcttaccatcaaaagacgtgtcgtgacttgatgagtatttggcatggcgatttttcgctaattctcggttagccaaaatgaacgagctgttgccgcacaataattaaagtcaggataaggatgcacatctgattcttatcctgattttttgtttgccagctgtatgttttaaaatgagagttgtttcatgcttgatgacaattctactcaaattcatattaaacaagtcctagagtccgtttgtccggccaagtttttatgctaaaatagttgaataatctaaaaaaactaacggagaattaaccatgaaatcaatcaccttacacttagtcgttgctggagcaacgtactttaatcaacttgaccggttccagggttggagcggcacgccgttgacggcgactggcgaacaggcgacggccaaggttgcgcagcagttggcgtcgacaacgtttgataccgccttcgctagtgatacgagtcgggcgattcagactgcgcgcattatcttagactcacgagcacaacccgttaagttgcgaacggtagtcgcgttacgtgcgccattctatggcggctttgaaggcactgaacgcgcggcggtttggtcaggatttgcgactaagctaggttatcagagtgtggccgcttttgccgcagatcagacccccagtgagctacagacattgttgcacgatcacgatgcggatggattggcggaaagtgggcaggagttctgggatcgctatcaaaaggggttacaacaggttatggcggcaacgcctgatcatggtcaggtcttgttgattgtggacggcgcaacgttgcgaatgatgcattacgtcgcaactggtcgtgcggcaacgagacaagaattggcaccaagtgtggtgacaacgatggtttacactggggataagttgactgtaccggtcacggaataagttatccactgtggacaactagtggcttgcggtttatacaaaagtgcgctactgtgaaaattgagtttaaaaattttaacgaggagcttttaaaatgcaagttaatgttattacgagtacggtggccggccaagagacggtcgcaactgcggatgtgcaagctttcatggccgccatggaaaaacaattgggtgcagatttcaacttcacgttagatacagattatggtcagagtttgacggaccacagcgcggacgtttacctagtttattttggctcccaagcgaacttatccccagaacaacggtcccaaatgatcatcttctattctgatgaagatgtggctaacttaacaatcggacgttttgtggatatgctacaacagttaaacaagcagtaggcactgcgttaatcacaagttaggaagtggcattatgcaattactaattttaggtgttattgcaattgttatctttatcttagaagagtacctgtttacggccagtcgctacttttgggtcggcggtatcgttccggttttatggacggcttttttggcgtaccttgtcgtggtcaatgccatgaacttaacggtgcgcgagtatgctttagcaattattgcggtcatcattccttatgtttgttggggtaacggctatcaacggcatcagaggcgacagtcatgaaaatccaaccgatagcggcagctcaaattccacgggatttactgttattagctgatccatcttgggcacaggtcacagcgtacttatcgacaggccaatgttatggttatcaacaagatggacaagtggtgggtgttgtcgtgttgacaacgttcaaaacaggggtgtgggaagttaaaaatattgcggtggcgcccgcctatcaacatcgcggcattgctaaggccttactagcaacggcaattgcagtctgccaagcagcgccaacctgtgatgaactgcaaattggcactggtaattcatcgttgcggcaactagcgatttatcaacacgctggttttgagatgattgaagtgtgggtcaacttttttgtggataactatccagacccgatctatgaagctggcttgcagtgtaaaagtatggtgcgattgagtatgtcaacaaccggggaggtggcacaacgtgtggaaaacgagtcatttaataattagttggttttacggtgcaatcgccgtcttcattatcatgttttttacggcccgtcaggaagtcaatcggatcgtgttagaatttaatccgttcgtcatttacagtattatttgtgcgctcgtgctgtttccaattgtgaagtatcgttggccgcgggtgtttcaagtctggcgtaaacaacccaaggaaacactgtcaacgcgaccagacgatgagcaaatcattcaggactctggccgaccatggtcagtagcagccaagcggacaaagcccaaacctgttccaaccgcattaacgccgcaagtcgaggctaagagtgacttcatggatggctttatcaacttctttaagaatattttgatggcagtgattttggttcctttaagcccaattatttgtgggtattttggggtccaggattggcgtcagcgccaaaaatagtcggagctgataatctgttcagaaaactgatcaaatcaattgaagacttatgcagatactgtggataacggcattaagttattaactgtggataaaagtctggttaacaaataaacgaatcaacaagttgttcataactttgttgattcgtttatttgttagttttgaaaatgattgatgtattgttgccggttctgtctaatgacgccaatgactttgcatcggccataaatgaggacaatgcaaatacagacgagtcatctgtataacaaaaaagcaagtcgcagttaacgacttgctgataaggtgttcaaatcttaaggttggtagttattaatatattgtttgcggttctgccatggccatgctttgacgaccccaatcatcttgctcttaggaacgagcccccagtaacggccatcgttagagacgctccggtgatcaccaaggacaaagtagtaacccttcggcaccgtattgttggtcacggacttggcccagccttgatcatggctcaaactattgagtgtccaaccagtgaacttactgtgactattagccatgaaggacccagtcgtttgttgatacttatttttgaggtaggtttgcttgactaatttgttgttcacgtaaagtttaccggaacttgtgtagcggaccgtatccccaggcatcccaatgacccgcttaacataaacggcgtttttgtcggtctggttcggatcgagtccgtaggcgttgaagacgacgacggaacctgctttgattttgctagtcttaaaagctacgacgcgttcgttattttgtaaattcggttgcatcgaagtcccatcgactttgaccatagtaaaccagaactgacgaatcagtagggcgatgatcaagccaatcgcaatcggaaccacccagctcataatgcttttaaatgttttcaatggttaaaactcccttaattgtgtgtatacctctcattataaacgataatgattttttcgcagtataaaaaagcttaaaagttcaacgatactcaaaatgggggcggttgctttcgagaatgcgtgttcatggtgataattgcgtgctatgctggtgaaagtgaaatgcgattgatgggaggaactgggagtatgaaaacacagaaagaacgaatgctggcgggtgagttgtacgttgctgatgatccagaattaggacgtgaaaatcatcgtgccaaacggttagtacgggaatttaatcaaacaaccgaagcccaaccagaagaacggcaacgattgttaacggcaatgttcaacaaaattggtgacgggggctatatcgaaccgccatttcataccgactatggaagtaacacgacaattggcaagcacttttacgccaattacgatgcgatttttattgatgtgggtcggattacgattggggacaacgtctttatggggccgcgggtcggcttatatacggcgggtcaccccattgacgccgccattcgtgctgaacaactcgaatatggttggccaattacgattggacacgatgtttggtttgggggcaacgtggtcgttaatccgggtgtcacgattgggagtaacgtcgtgattgggtctggttccgtggttactcatgatatcccggataacgtggttgcggtcggcaatccttgccatgtcttacgagaaatcaccaccgccgaccatgaatattgggctcggcaacgggccgcctattttgctgatcgtgatgatgattgatagaaattaatggtactgtgttcatgtcattagagtttggattagaaataaggccgcgatatttttaataatagacattacaccccctcagccttaaaattaacttagaaacaggataagaaagaggcggtaagcgcaatgctaaaagatgatcagatcgtgtgggcaattcaccaaatggaagcagacatcggaccagtggggccttccctggactcgcggacgccgtttcagtatttgatttcagtaattctgagcgctcaggcgaccgacgtctcggttaacaaggtgacgccggtgctgtttgagaagtatccagaaccaaaggacttgatggctgccgatgttgcggatgtggaagcaattatcaagagcgtcggattatttcataataaggcccgcaacatcattaaaacggcgcgcattgtccatgaagaattagccgatgtcgtgcctaccgatcgtaaaggcatcatggcgttaccaggtgcgggccgcaaaactgccaacgtggtattgagtgacgtttttgaacaaccgacgtttgctgtcgatacacacgtctcggcaatctcgaaacgcttgcactttgtcgctcagaccgcgacgccgttacaagttgaacaaaaaatcgtgagtgtgttggcaccggcagaattacatcaagcccatcacacgatgattgaatatgggcggaagtattcgatgaagttgacgccagacaaagaagtttgtcaattgatcattgactgtgacaagttgaatgaggaaaatgaagcgttgatctagtagtgtggggcgacagcgagcatattttagccattggtagaactgcctgtaagtcttgctagacgtgtaatcaaagccaggttacgctaaacaacctcttttccgacaggccgaagttgactgcccttgaccttaactggcgggcttatttttagcataatacgtactgacgcgagcattaagacgagtggtggtcttgatgttcgcgttttttagtttgttcatggtcgtgtttttcgatgcgtctgaaaaataggctattcagaaagtaagtaaaaccgaacataaaaacaattagcattaaaacagtcgcaatggcttgggcaatcatagttggacctcctcggataacgggtgataacactggaattatcagtgtcagtgactgttgtcattgtacgggcaatgcgaggcaaaatgcaagcggtggcttaaatgctaaccgtgaatcttgaaaatacggtatgataatagtaactgattacatataggaggctaaattatggcatacatcgaagtgcagcaggcaacgcgccagtttaaaaatggtgagcaggtcaccgttgctaatcgggatatttcatttgaagttgaccagggagcagtcgttgtgattttaggcccgagtggtgcgggaaagtccacgttactcaatattttaggtggcatggacagtcctacgagcggccgtgtactggtggatggtgtggacattgcgcaattcaactcacggcaattaacgacctatcgccggcaagcggtcgggttcgtttttcaattctacaacctggttccgaacttgacggcgcgtgaaaacgtcgagttggcgtcgcaaattaccaaggacgcacgcgacgttgatgagacgttggccttggtaggactgacgcaccgggcagataactttccagcccagttgtccggtggtgaacaacagcgggtcgcaattgcgcgggcagttgcgaagaatcccaaattattactctgtgatgaacccactggcgcgctcgactatcagacggggaagcaagtcttacaggtgattcaagatgcagctaagcagacgcagacaacggtcatcattgtgacgcataatagtgcgattgcgcagctgggtgaccaagtcattcgtatcaatgatgctcaagtgcagtcggttgagcataatgctcatccaacgcctttggctgagattgaatggtaggtgcagcgatgacagcagcttattttaaaacaattatgcgtgagatttggtcgtcgaaagcccgttttgcttcaatattactgatcattttcttaggggttgctttttatacgggaattcgggcgactggtccggatatgtcacaggcagctaatgattattatgcgaagcaaaagctggcgaccaatagtgtccagtcgacaatggggctgactaaggccgatacacgagtactgaatcaacaccgctcacagctcacttaccaagcgacacactacgctgatgttaatcagttgaacaatagtcaagtcgtgcgggtgatggtgttaccgacaacccaacgactgaatcggttacggatcgttaagggacgattaccgcggcatgccaatgagatcgtgttagacgcgcaagcacagcgattgcagccgaagctaaaagtcggttcaacgtatcgaattagcagtacggctaagcgcaatgcacagttcacgcggcgaacattcaaggtcgtggggtttgtcaattcaccaacgtatgttgaaaatacgaatcgtggcgtcaccaacgttggtaaagggactttggactacttggtctatgtccgtccgcaggtgattaagtccagtgtgataacgcgcattgacgtgcaattcaaaaatttgcggggcgtcaccccctacacggcgaagtatcggcgcttgaatcgcgagaacaccgcgcaactcaaacgctggttaaaaccacaagcgcgtaagcggcagcaggcattacaagcccaggcccaggctaagctgaaaccattgcaacaggcgacccagcaacttgctagtcaagtaccagcgggaacggcacaactagtcaagttacaaagccaattaaaacgcgcgcaggcccaggtcgcggccatcacaatgccgacttatttgtacactgaccgtacggataatccgggttacacagaatatcacgaaaatacgcaacgagtcgtggcactgtcgactgtctttccgctgttctttattgcgattgccgcgttaatttgtctaacgacgatgacgcggatggttgaagaattgcggctacagatggggacgttaaaggccctcgggtatacgaataccgcggtcggtagcgagtttatgatttatggtggtttagccgcactgattgggaccgcgctaggcgtcttgttcggcgtcaatttcttcccgcggtttatcgcgcaggcctatggtagtatgtataatttgcccgcaatcaacgttcaatacatttggatggacattggtatcgccttagccattgcgttgttgtgcacgttggggacggcactggtcgtgctccgcgtggatttaaacagtttacccgcgcaactcttacagccacgatcacctaaggccggtaagactttgctattagaacgctggcaatggctatggcatcggctgagttttaatcataaaatcacacttcgtaatctatttcggtataagcaacggttgctgatgaccgtgctcggtattgcgggctgcatggcaatgatgattacggggtttggcttaaaggattccattggtgatattagcgtcaagcaatttaacgaattgtggcactacgatgcagtggtgacgcgtagtgggaacgaaacggaccaacaacggcaagcacttagtcgtggtcaactttaccaggctagtttgaaattacaggccaagcaggtgacggtcaaacagtccggggtagcagaacagacggctacgctcggtatcccggcaccccaccaatcgctaagcaagttcgtggtattacggcaccgacaaagtcatcaggccattcatatcagtaatcgtggtgcggtcatcgatgaaaaattagctaagttatatggcgttcaggcgggcgatgatttaacaatcaagttggccgggcaaaccaccaagcggattcacatcagtgcggtggctgaaaattacgtcaatcactttatctatatgagtccgacttattatcgacgtgtcttcaagcaggcaccagtatataacacgaactatgtccggtttaagcaggcaacgaaaaagcaagaaaatgcttatgcggatcggctattgaaacaggcgggggttcagaacgtgacactgatgagtacagagaaagccactaattttaaaatgctggatagcatgaacttagtcgtattgatctttgtcatctcggcgggggcactagcgctagtagtgctctataacttaacgaatattaatgtttctgaacggatccgggaattgtcgacaatcaaagtgttgggcttttacgatggtgaagtgacgatgtatattttccgtgaaaatctgatattgacggttttaggcattattgccggttgtttcttgggcaactggttgcacgcatatatcttgcaaacggctgaaacgaacgcgttaatgttttcaccaacgattcatccgttgagttacgtttacgcggcattattgaccctggcctttagtttattagtcatgggaatgatgcatcgtaagttaaagcgagtcaatatgctggatgcactgaaatctgtcgattaaacgtgtctgacaacggccaacggtagccgaagtggtataattaaattgattggaacagtttaattaaggatgactaggggatgaatggcatggcagaaacggcacagttagaagctgctgtacaggcattaagcgatattgtaaaaatgaatacggtaaataaccatgagcaattggtggcggattatttggtcacacttttaaagcaacatggtattgaagcacaatcaatcgagtacgctcccgggcgggtgaacttggtggccgaaattggtgatggtcacggcccagtcgtcgcgttggatggtcatgaagatacggtggcgttgggtgatgcagataaatggcacacggacccgttggcagcaactatcaaagataatcggttgtatggtcgcggtgtgacggacatgaaggctggactaatggctgaagtcttcgcgatgattgcattgcacgatcaggacgccccactccatggcacggtgcggttactcgcaactgtgggagaagaagtcgaccatttaggcgctgaacaattgacggaactcggttacgccgatgatattcaaacgttgatctgtgcggaaccaagcggtgcggacaaacaacttttactgaccaagtcgattcaagccatgttaggtgttgacggcgatacggcgcaacggatggcggatgctaatccgacgaccgaacaacacttcatcgaattagcgcataagggttcactgacttatacgattaaagcgcaaggggtggcggcccacagttcgatgccagcgattggtcaaaacgccatcgatatgttgatgacttactatcagaaacaaaccgcctattttgacagtttcaagactattgttaatcccgtattgggcccaaccgtgcctgtcgtgacgttaattagtggtggcgaacaggtcaacaccgtcccagccagtgccgaaatgtcagtaaaaattcggacgattccagaattacggaatgaccgcttgattaaggatttggaagccatcattgctgaatgcaatgcagatggtgccaatctaacgatggacatcgcaagttcgttctacccagtgcatacgccggaagatagccagttggtccagttggcgaagaaggttggggaacaagttttacagcaacggctcccgtactttggtgctcctggtgggacggacgcatcgtcttatattgtaaagagtcctgatatgcaagtgattgtcttcggacccggcaatattacagcgcaccaagttaatgaatatgttgatttggatatgtatgggcgcttcatcgagatttatcaaaaaatgattacggaattgctggcttaacggaaacgtcaataagtgtgaatttaattgtgccggaaaaggtttcaaaaaaagtaatagtcgtttcaagaattgattcttgaaatgactattactttttttgagcaaggcgactgaatctcggtgtatctaacttaataatgattgtggtgacggttgtgcgttattcagttattcgtgatgcccaaaccgttgcaagtaactcgaaaaatcttcgtgatcctgggtaatgccagcttccttttcttcataccaattaattttgtcgttgagaatctgtagatgatgctgaacttcgttgaactggacgagaaagtcttctttaacgtgtttgagtagtgctaatcgctggggaatcgtgttgtcgccggctgcgcgccaggtaacgtattgttgcaattcgctaatactcatacccgttcctttaagatgcaataagaatttgacccagttaatatcggcagtctcataatagcgccggccattgtctaagcgatgtggttcaatcaagcccgctttttcgtagtagcgtagtgtgggggcgctgagaccaacggctttagcgaagtcaccgattgaataacgttctgtagtagtccttaccaattttaaaattctccttattctaacttttatttgaagtaactttagcaataacaataccacgaaatcctattttagcaagtttaaactttattgttgacttaaagtgcactttaagttgtaagctgtattcatcaatcagttagcaagcaaataattaaggagtgtttttaatatgacaacaactaataatagcggcctatttggattaggtgtaaagaatgaggcataccaacaatactttatcggtcaaagttacctgaatgccttagccggtgatgagcaggtcgacgtgaatgtttccaacgtgacgtttgaacctggctgtcggaataattggcatatccatcataacggataccaaatcttattggtaacgagtggtgaaggttggtatcaagaggctggtaaaccagcccagttattgcatcccggcgacgtggtcacaattcatcctggtgtgaagcattggcatggtgcaacaaaggatagttggtttgcccacatcgcaattactaagggaactagcgaatggctcgaaccagttgatgatgaagcctacgcaaaattataaaagttaaagtagttatcgaaggaggaaactaatatgacagttaaacaaaccgcaggacgcgacaacttaggcaaattagcaccacagtttgccgcattaaatgatgatgtgttatttggtgaagtctgggcacgcgaaagcgcactaagtttacatgatcggagcatgattaccattgcgtgcttaatgaccagtggtgattttccacaattaaaggcgcattttaagatgggcaaagatcatggtatctcaaaggatgaagccgttgaaattgttacccacttggctttctatgcgggatggcctaaggcgtggtcagcaatggcactgatcaaagaagtttacggtgagtaggaggaacagttagatgacagttaaaaacaaagtcgttgtgattacgggggcctcgtccggaattggggcgacgaccgctaagcaattagccagtaatggtgctaaagtcgtattgggcgcacggcgtgaagaacgcctggctgctttagttgatgaaatcaaggcagctggtggacaagcggcctatcaggtgacggatgtaacgaagtcggccgatgtacaagcactggttaagctagcgcaaacgcaattcggtgggcttgacgtgattttcaataatgctgggattatgccgacatcgccaatcagtgccttgcacacggatgaatgggaccagatggttgatattaacatcaaaggcgtcttgaacggggtggcagcggttatgccaatctttaccgctcaaaaatctggtcagattattacgacatcttcagtggctgggattaagtcctttgctggctccggcgtgtacggtgctacgaagtttgcggttcgtaatttgatggaagtcattcggatggaaagtgcccaagaaggtaccaatattcgaacggtcagcttatatccagcggccatcaatacggaattactgcacacgattacggataagacggccaaacagaatatgactgatttttatcaacaagtgggaatcagtccagcagccgttgcgaacgtggtcaactttgccattgaccaaccagaagatgttaacgttaacgaatttacgatttatccgacgaagcaggcttaacttgatttagctgttgttaacggttgtttgagctagttgccgataagtcgaaaatgtgaattcaaaaaatacaagcacccggtctagcgcataatggcgttgctagaccgggtgcttgctgttgttataaatattcaactagtgggcctacttcaaccgtaagccgcgctttaagttgccccagaaaccgagttcatccgtttgtaacattagcccaccatagattcggccaatgtagatcatacttccaatgattgttgcaatgagaatcaggagtgacacgattgcagcgggcatcgttgccatgccgttaatgaggcgtaatggcatgaagtatgatgagaagaacggaatatatgagaaaatcttaacgaagagattggtgggtgtgttctgaaaggctagggccatgaaaaacgctagcatactcagatagatgaccggttgtgctgccttgctagcatccgcgacccgggtcaccaaagcaccacagaaggccgacgctacggtgtagagtagtacggccagtaatgcaaacaacaagttgattgagaccaagttgtgaattacttgattgatcagatcggtattctgttgccaaaaatcaattgtgagtgagctacgtttaacgaattgcatgacggcaaagccacccactaagtagacgagcagctgagtcacaatgactagtaagacaccgtaaattttaccattgaagtatttccgcggtgtcgtactcgagaagatgacttccataatcttggtgcctttgtctgcggcaatttcttgggctgtgattgctgaataagtggtcaaaatcaagtagacaaagaagacgacaatatagaaggagaccgttttagccgttttatctgaagcagcgtgtttctgtaattgttcagtaaattttggctgtacagccaacgcctgggtctgcttggcacttagttgtgcgcgctgtacgttacgttggctttgggcagtggctaagaactgctgaatcttagccttgtcaccgctgctgacagcattaggaccagtgaactgcgcttgcaactgttgattcttggttgttaaaacgaggtagccggcgatgtcattgcgctttgtcgccgccttagcgctggcgagtgtttggtatttattagcggtagccacatgactctgcttaatgaaacttgtgcgtaattgtgggctagtgctaacgaccgcgatgtcattcttactagcgctgggtgcagcaaaataagaaaaggcggccacgaacccgaagaacaagaagggcataaagacgagtgacaaaaagctccaggacttgatctgccgcaagtaggtttcaaaagtcacaatccaagtcttattcatggttaacacctcccgcttcagttcggaaaatctcatccagcgttggtggctgctgactgaactcttcaatgtaatgaccagcagtgacttgatcaaaaatcgctgggccaactgaagcatctgcaagttcgagtcggaatcgacgggcaccttgttgagtaacggtggtgactcctggtagatcggccagttgcgcttgtgaccagtcagtcgtcaagaagagacgggtccggccaaactgggcgcgaacatcttcaacggtacccttaaggactgcttcaccattacgtagcataacgagtgagtcacagatcgcttcgacattactcatatcatgactggaaaaaataatcgcggcgccccgttgcttagcatctaaaatagcttgcttgagcaggtcggcgttgaccgggtccaaaccactgaacggttcgtctaagataatcagtttgggatcatgaattaaagtacaaatcagctggaccttttgttggttccctttagataacttatcaatcttatcggtcggctgccccttgaccgcaaagcgcttcatccatgcggcaattttgcccttggtcacccgtgccggctgatttttcaaacgggccaagtacacgatttgttgtgtgatggttaatttggacattaggctacgttcttcgggtaaatagccgatttgatcgtagtcatcagcggtcaacggttgcccattccaagtaatttgaccgtcgaatgatagaaaatttaagatgctgtgaaacgtggttgatttccccgcgccattttgaccaatcaatcccatgatttctccgtcatggacatcaaatgatacgtcatttaatgcttgaacagtcccgaaacgcttctgaatatgtgcgatggatagcattagtttgtcccccaaattcttgaaataaagtcattacgtgttgtgcgagctaattagtcatgaaataggatcaaaacgtgccaagtttagattgttattcgtcagccggtgtgcgttctatgccgacctccggggctgggtgacaattgctggaacgtagccgacgtcgatttgagctaacgcccaacccgcgtcatctcaaatacgagtcttattctaagccggaagcaacccacttccagctaagaataatttggctactgagcattgtcacccagcccctccagtcgggaacccgctcgaatggctgatgaacggctacttaacttggtgaaatttgtcgttggctattttgatacgggaactttaaataaaacatcagggtgcataacctactttgtcgcaacattcaattttgactacagcggcttaagatgttgagctattccaatatcattttcagtctgatagttgctgagagaaattactatttatgaaaaacaatgacgaattcaccaaaagttgggtccgcacatgtccgccattcgaacactgtcccgactggaaggcgtttcggccaatgctcagcggtgaaattccacttagcaagcgtctttggcttggttagtggaagaccagtatttaagacgtgggcttcggcttaaatctgtgtccaccgcgttccagcaattggccgaaatgcctggaagtcggcataggacgcgccaactaagtaattttacgctaactcgaactttttccagcgggcctaagctggctgcttttgaacttacacaacttggcacgttttaatcctaattaggcctaataactattggcacaattagcaatcattgtttgattttatgatgacatagttgattcggtgtgacaagggcgtgcgcttggttctaagtgaagcttatttgggcaagcgggcgttttcaagagctaatagggcgcgtttcattggcaaaccaccacgatagccgccaagttgaccgtctttgcggcggatacgatggcaggggatcacaataaggagtggatttttaccaacggcgctggcgacagctcggactgcggtagggtgattgatcattgtggcgagttgtgaataagttgcagtttgaccgtatggaatacgggttaaagcttgccaaacttggtgttgtaaaggggtgcccgtcgtttggtcgaggggtatgtcaaaatgctggcgttgaccagttaggtaatcatgtaattcttgacaggcctgttgattagcttgttgatcataatgaatattagcggatttgaagaaggcttgccattcgtcgcgtggaccgttggcacggccgacaaaggctaagccggtgggcgttgtgcccagccagtaagtttgctggttaatggttgtttgggtcaatgttaagtgcatgtgtgagccctccgtctcaattaggatagcgttagtataacagaattggtgatgtgacgacctgattaaatcagaacatcactgctatatcttaatgaaaaaagccagtgcgaacgatgagtcgtccgcgctggctttgatgtcaatgataaagcttgaatttgataattgcagatgctgattagtaccagccgtttgcttgccagaacgctttagcagcagtccatgagccgtaacggccagcgacgtatgcgtcggcagtcgcttcttggttggcggcagaataatcgccatttaagagggattgaccaagttgatatttaccatagtaaataccgttggttacggtgtaggagccaccagattcgcgagcagcaatccaggccttggcagcagcctcagatgtactagtcgagctggttgtcgtgcttgttgttgaactggccgtgcttgagctagcttgactggcagttgtgctgctagtacttgcactactagttgcggctgaactagcggtggtcgtcgtgctttgactggttaccgttgtactttgactagccgcactttttactgaactagcactggcttgactagtactgctttggctagcggccgacgttgcactctggctcgtcgtactagtgactgaactagcactggcttgactagtactgctttggctagtggccgacgttgcactctggctcgtcgtactagtgactgaactagcactagcttgactagtactgctttggctaacggccgacgtcacgctttggctcgttgcactggtaactgagctgccgctgttttgactcgtgctgctctggctaacggctgatgtgctgctttgactggctgcactggtaactgagctggcactggcttgactcgctgtgctttgactaaccgttgacgtggcggtaacggtgctagtaggactttgaacggcggcactagttgttgtagtcgtcgtacttggcgtggctactgaggtggtggcccgtgtcattttaactgtctggtgtttgttaacttgtagtttgtccccgacgtagattaagttgacgttcttcaaatggttcaacttttgaacggcggcaacggttgttttgtgagtgtctgcgatttcactgacagtgtcaccagccttgaccgtcaccgtatcggctttagcagcagttgcaccaagggcaatggcaccagttgttgctaatgaggataataataggtgtttaattttcatataattgattcactcccaaactagattagacttcccttaaagtttaccatcatgtaagcggttcgttaagcgcaatttgcttactgacggactttttagaaaataaaacatgcccgattaagacatagtgtaacagattaacgcttacattaccgctaatttgcaatgcaatcttagtgacgagtgtgtcaatgtagtgacctgcgtaacgtgattacgttgacggtggggggcatggtagaattggacttttgaaaagccctcccaaattgactgcggcttgcacgtgttcgactttaccagcagaccatttgcatagtggttgatgaaggactgcaataagggccgatcatggggggattgccagtttgcagtcaggcaagtccgatgcacctatatggcaacagaaaaacgcggcccccatataggaccgcgctgattgtatgttcagttgtacatgaatgtgtttagtaataaccgttggcttcccagaaggccttggccgctacccatgaaccgtagcgtgaagccacgtattcgtcagcgacggtttcctgattagaagctgagtagtcaccgtttagaagtgacttgctgagttgatacttaccataatagttcccgttagatgcggtataggagccaccggattccttgttggcaatccaggcttttgcggcagcttcagcactacttgatgtgctagttgttgatgaactgctgctagtgctcgttgtggtgctgcttgaagtggtagcactactgctggctgccgtacttgtgctggcggcactggaagcagtggtgttgctcaacttcgtcatagatgcggaagtggcggttgaacttgacgccgtgctagcttggctcgttgcagagcttgaagtggcactgctagttgacgaactggtggcactacttgaggccgcgctggcggttgacgtgctggtcacgctacttgaagcagcacttgtgcttgatgagctggcagcactacttgaggcgacacttgtcgttgacgaactggtagccgtgctagctgctgacgtacttgtactgctgctaacggatgcgctgctggcactttgggtgctagtactgttggccgttgaactggcagtactggtcgaactagccgtacttgaagcagcactagttggtacttgggtagtaaccgtggttgcgtggtgtttgccgttgacttccagtttgtcaccgatatagatcaagttaacgttctttaaatggttggctttttgaatcgctttgatggtcgtcttatgcgttaaagcaatttcactgacagtatcgccagctttaacgacaacggtatcggcattagcaacggtagtacctaaagctaacagaccggtagctgccaatgaagttaatagggcatttttaattttcataagttaatcagtcactcctataaaagttgtgttgttatttcgattgaatggtgattagtataccgaccgcagattgcaaagcaataaataacagattacggtttgagccaattttgtaataaagtaacatggtgtaacaagttaacactttcatcatgttttcgccacattatcatcacactcgcggtaaaattcagaaggtaacttaaaaaatggcttaaagctgtgagcgatattcttattaattcagtaaaatttgttataatcgagaccgttaagcagaacgtcgtgtaagggagcgagtaataatgtattattttgtgaataccagcattaacccgaaaaaatcgggaattgaacatgctgagatgaaacggctggcactttttaaccagcatcacgttcctgctaagatggtcacgcgatttttttcattatcgttacaccagacactgacagcagcggggattgcggctgaaaatcaaattaatctgtttgatttcattcagcattccagtgaacggccaacgactaagatgacgattgaagatctgcatctagcaccggacttgcgtgtgcaacccgttgggcgtcattatgaagtttatcaaaatgaccaattattaatgaaggtcaatacatttctgaacactcaaaaacaactgaacaatgtccaatattatgatcaaaatggtaagttagtgaagaccgattggtacgatacccggggatttaaagggcttgaacagttctatgccgctgatggacaagtagcaagtgaacaagtctttaatccggacggggaggtcgtctatcagacatttcatatggcagatcgacaaaatcaggtccaaaattcactttatcgattcattaattatgaggggcaagactggtcatttgctggtgaaacggcaatgacaacctttttcctcgatgaacttaatcggaggacgccgcatgcggtctttgtcattgatcggacgtatgagttggcttacgccgcacttcacatgcgaactaaagcgtttaaagtcatgcacttacacagtaatcacgttaatgatccagcacatccgaagacggctagtctcaactttaattatgcttacgcgctcaataacctagaccaatggaatggcgttattgcgtcgactaagcaacaaactgctgactttcaagcccgctttggcaatcaacccgccgtttatacgattccagttgggattgtcgatgacgcgactttgaatgcgcctaagccatcttttgatcagcgcaccgcaggcaagattatttttgtggcgcgtttagccgaagaaaagcaacaagatcaggtgatccgggcattcaaaaaggtattggcccaagtgccgaatgcgacccttgatttctggggctatgcaaatggagataccggcaaacaactgcatcaacttgtggaacagctgggactgaaagcggcagttacgtttaatgattatacgaccgatttaacagctgtctataatgatgcgcagttggcgatgttaacgtcgcgggcagaaggttttgcacttgccttgcttgaaggtcaggcccacggggtgccccagattgcctatgatgtcaaatatgggccacgtgatattattcgggacggtcacgatggtcaattggtgccggtcaatgatgaaaatgcgttggctacggcgatgatcgacttgttaacgcagccgaaaaagttagccatgtatagtcaacaggcttatcaagatgcccaacgctttagcacaacggctgtttggcaacagtggcaaccactcatgaaagccgcagccgatttttatcaagttgagggggcaacacagcgatgaatttttttgtgaaccaatatttaatggcgttaaattctggtgtggaacatgccgaatttaaacggctccagttgtttaaagatcatcaggcaccggctaaactagtaacgcgtcaattcgatggtttgttacatcagaatatgcggcgcttcaatattgccgatgatcagatggccaacttgtttgacttttttcgtgaaacgaccagcttttccagtcgggtcatcaagatggctgatttgaactggccaactgcctatgacattaagccggaccccaatgtcagtgaggtacgagctggtgatcggctggttgctaaggtccactttgttcccagcacggtggggcacgtgtacttcattgaaatttttgatcacttcaataatcttgttcagcgtactgattatgatgaacggggctttaaggcccgtgatgaattcttctcgtcagccggggaaccaatcacggatattttctatcgaccagatggtagtcggatggccgaacagtattatgcgcatgataataatgggactaattatgtttcgttgtgccatcttatcaattatcatggccgtgactactactttaatggtgaacaagaatggtaccggttcttcttagatgaactgaacaagcaatatgatgaaaacaacgtctttattgcggatcggccgttagctgctcagtggccggtggtgaacatgcagacggcggctaaaaaatatttgtggttacccacgccacatgcagtcgatccgcgtgatcaagtctattctaatttgaataacgcgtatgtttatggcctgcacgagtttctgagtgcttgggacggtgtgattacgagtaccgaacaacagaagcaagatttgacgcagtggctcggtggtcaaccgagtgtcccaatcctgacgatttcagcggccgttgtttccaaacagcaagctcaacacgcaccaatttcgatcagtgaacgtcatgcgcatgaaattatttataccggccgtttggatgcggaacggcgcgtcgatcagctggtgacagcttttgaccaagtgcaccataagattacggatgcgaccttagtgatttacgggtatggtggtgaacttgaccgtctaaaacagcaagtgtcccagttgcacctagagaccgccgtgacttttgctgggtatcaaccgaacttaacaatggcttatgatcaagccggtgcttacgtttatactggtgaaagtgatgcgcagccattatcgttaattgaagcccttagtcatggtgtgccagcaattgcttatgatattaactatggtcctaaggatgttttgaaggatggcaagaatggttatctggtcacggatggtgccgtcaaccaactagtcagagcgctgacccgaacacttgaaagtccgcaacgtcagcaacgacttagcaagggtgcctatcggagtagtgaacaatatagtgatgaacaagtttggcaacagtggcagccggttgttcagtgaatatcaaaaatggtctgactttagtggtcagaccattttttaaacgctaatgtcaaaaagacctaataacaacggcggggatcgctaatctgaccacgttgttaggtactgggtaattgcagtctgtacggggcgcagtgccgctgccggttgcgtgttagtcagtaaaaagaattggcgttggtaatgagcacttagctgttcgatgggaatctcgttgcttaaaacgtgacgtgaaataattgtttggccgataccatgagcgaggaggtccgcgatgatttggttactgtggatgaccatgacttgtgctggctgaatgttgcgggcttttaaaaaggcgttggtataatgacgcacaccggaattaggttcacgtagcagccagaggggactggcaaagtcgcccgcatggacgagctcatcgtgaccaaatggcaagcgattgagctggtcagtaacgagtggcttttcaactaaaccaaagtccagtttgtgttgggacatagcggtcaaaatttcggccgaattggcaagcgtcacttgaaagtcaaagcgatcactgacggcactcaaattggctaataaggtgggtagaatcagacgcccggttgtgtgtgaggcaccaatccggcaaggaactttcactaagtggcgtggtgattgcaccgctgttttggtagcggcccaagttgttaacagcttttgagcctgttgatagaggagctgaccactggcagtaggaacgatttcttggcgcccgttacgtgttaagagcgtggtttgtaaatcggcttcaagttgtttgatttgtgttgagacggtcggctgggaaataaaaagttgctcggcggcatgggagaagttgcgagtttcgtataccgcacagaacgtttccaattgtttaaacattgtgttcacccctaactattatgtttattaatagtaactatcataataatttatttctcaaatgtaaataactttcgtatacttaaaagcatcgagatagagatgggagaaagcgaatgaaggtcaaagggattttaccggggttagtgaccagtctggtcattgcaattattagtcaaggattggcgcaatttgtgccagcgttaggtgcggctactatcgcgattctattaggaatcattggtggcaatacgtttctgaaacaaccgcaacttggtcgggggactaagttcgcagaaagtaagctgttggaatattccgtgatgttgctcggtgcgacgatgacggtacagacaattggcaaaattggtgggttcggcgtgctctttattctttgccaaatgacgattacgatcgttggggctttgtggttagggcgtaagctgggtttcagccagtcggtacgtatgctgatggccggcggtaacgccgtgtgtgggtcgtcggcgattgcatcaatcgcacccgttattgacgcggatgaagatgataaggggactgtcattaccttagttaacttgatggggacagtgctgatgttaacgttaccggtcttaggaatggccgtgtttggtggcagtgtcattcttaaaggggcgttgattgggggaactttacaatcagttgggcaggtggtggccgcagctagtatggttaatcaaacaacggttcaatttgcaacgattttcaaaattatgcggattatgatgctagtcgtcgttgttttgatttttggccggttacaccaacgcacgattgaaaatgaattggctgaggatgctgtcgtcagtggtaatgggaacggtcattggttaccatggtacgtggccgggttcttaatcttatgtgcattgaatagcttgatttcgttaccagcaattattggcgcaacggctcatacaatcagtagttggtttgaaatcattgcgttagcagctatcgggttacgtttgaatcttgttaactttatgaaagctggcaagcgcttagcactgtatggtttaggcgtggggacgattcaggtcgtcagcgccttgattttaattacgttattactgcaacattaattgggttttgagacacttaaatcgcaatcatggttaatcattcaattaatcatgattgcgatttttcatctaagagagtaggaatgttcatgctaacttatcgagtcacaccagcgattgaattgcgagaaccgctaccccaaagcgatgcgccggcattactagcattattaaccgctaatcgtgcgcagtatcagtattatttgccatgggtggctaaaattcaaacggtggcggatgaacaacgctttttaacttttgcacaagctcagttacaacaagcgcaagcgctcaacctagtcattgtcgttgaacaacgggttgcgggaatggttagctgtgaccacttcgatgataacgaccacagtgccaacatcggctattggttgggacgaccatttcagggacgcggcgtcatgacggcagccgtccgtggcgtttgtgacttgggttttaatcagtatcatcggcaatgtttgcggattcgtgcggcggtggacaatcaggcaagcaatgcggtggcgcaacggacgggctttgactttttgattcagcatccaggtggtcagcacttattggatggcgatcatgatgagaatgtgtatcaggtttcagcggttgattggctggcgaagcgccacaagtgatgacgattaaacaaaataaaactgactagccaagatggttagtcagttttattaacatctaatttttaactgtcaccacttgccacgtcttaggaattgtaaacaaatattggcgttgaacaatttttgtcttggtatttcctaggctgaataacacgtgtgtcaggtgatttttgaactgccaagtcgtggtctttagttgaacctgcgcgggtgaaccgctagtcagtttagttgttgtggtggttgcggtcaccgtgtgactgactttagtggcggctgcaacccggtaactgatgacgcgttcagaccctgttccgagttgctggacccgcaacgctacttgtttggattttagcggggctaagtcttgaatctgcgtgcgggtgacctcgtgcatgccccaatggtaattgtcgtttaggacgagggcgatgaggctagtggcaataatgaggccactaatgataatggcaatgagacggttacggcctgccggtgaaaaaatcatcgtgccagcaaagacaaaggttgccagaattagtaagacaatgatcatgcggcatcatcctcctgactaatggtttttgaatgattggcttttaagaagaaggtaatcccaaagccaatcgcacaaaaaatgagtgagacaacgaacgccatgtgataaccagttaaggttgcggtgattccgtcctgacggtatttcaaaggtgcctgtgtcagtaattgatgtcccggcatttgccacttagcgacgctggagtagacactgattaaaacggccgtccccattgaagctgcgacttgacgtagggtgttgttggcggcggtcccatgggaaatcagccggaaaggtaacgcattgatcccggtcgttgtgacgggcatggtaaccatggtcaggccaaacatccgaatggcgtaaacaacgatgatccataagattggggtcgtggcactaattgataggaagaaagcagttactagcgttaggagtaacatccccgtcattgctagtctgcgggcaccgatatggtcaaagatgcgaccagtaatggggctcataatccccatcatgattgcgccaggtaataaaatcaatccagagtccattgctgaacgaccgaggaccgtttgaatatacattggcaaaatcatttcgacgcccatcatagccatgtaagcgagggcggtcaggattgcggatagggtgaaagccggaatcttaaagacacgtaattccaataatggctgatccatgtgaagttgccgccagacgaatagaccaatgaaaatcagaccaatgactaaagttgtgagaacgactgggtcgccccaaccagcattaccaacggatgaaaaaccgtataacatactgccaaaaccaattgttgagatcaagactgaccaccaatcaattggttgtttggaagttggtaagactttccgcaaagtgaagaatgaaacgatgatgactaggatattgattggcaggatgaataagaagagtgcccgccaggaatagttatcaataatccagccagagagtgtcggtccgatggcgggtgctaagccaataacaattccggctgtccccattgcggaaccccgtttttcgggtggataaactgaagacatgattgtttgaaacactggggcggaaattccgacgcccattgcttgaatcattcgggcaatcagcaacatctgaaagttgacggcaaagtacgccagcgtagttcccagaccaaaaataagcatggctgttaagtacaaatacttggaattgattcgggtcagcaaccaggcactgacgggaatcataattcccatgattaacatgaaaccagtggtcaaccactgaacggcggttgctgaaatatgaaaatcggccattaacgttggaaaagctgtcgttaatagtgtttgggtaatgaaggtggtgaacgtcccgacaagtaaagtcaatacaagccaagtccggtgatagggctggccgttggcatcaagcggcaacgttgaattttgagttggcataataccgtcctttcttttataaattctgtaataatgcacaatcaataagtatatcacgatgcaagtcctagtcctattaattggtaccggggcggtctgctgagtgttcggtgtcgtggtaaaataaaatagataatattagttaatttgtggtgagtcgtgctaataatagtcagcacaattcatcgacattcagtaaggaagctaaaaaatatgaccaaaaaatatttaacatttgattgttacgggacgttaattaatactgagccgctgtatcaatgggtggctaatttaggattggcggttggtttagacccactaacggttcgcaaagcctacgcgacttatgaggacgatcctgccagtgtcaatccttatctagattattcaacattagtccgggctgatcttaagcatttagatcgattgtttgaacagagacacttctttgaaagtcattacgttgaatgcttggaagtgcaacgacacttattaccatacgccgatgttataccgaccttaacagcgtggcagcaattgggctatcaattgattattatgtcgaattcttcctgggatattatgccggccaacattgctgctttaaaggtgccgttcacagcggttgttacggctgaagacgttcaagcttacaaaccagcgttagctttctttgaaacggttcaagagcgttttaagttaacagcagataatcattggcatattgcacgtggctatgaatccgatgttgttccagccagtgctatgcagtggccgatgatttggattaatcgtgatcagcgacaaccgactagttctgaacggccgacccatatggttactgatttggccgctgctaagcagtgggttaactaggcgtgcgcggtagtgtccccgttgatcaacagttaaaacactggttgatcatcagggttgaacaagctttctaattttgactaagctgttaaatctcaaaattggaaaggaaattaacgtgaattcaaaatctttaaataaaagtacggtcctattaatggcgatctccgcggccattgtagtggctaatattaattatattcaaccgattgaggcggacattgcgcaacagtttaatctcccaaacgccgttattggcgcggtggcaatgctgacgcagttaggctatgccttcgggttgctcttaattgtacccatgggtgatatcatgaatcgccgaatgttgattatgcgcttactggtactcgcaatcatttcagcgttactagccttcgtggctcccaatatttgggtgtacgccttggcaagcttactgattgggataacctcggtggcaccacaagttattattccgtacgccggctttctcgcacctcgtaatcagcgtggtcaagtcttgggcaacgtcctgagtggcttgctcgtgggggttctcttgtcacgaactgtcagtggggtacttgcgagctatttgccttggcagatggtctatctgattgccgctatcttgattgcaggattgtggctcgtcttgtggcgaaaattaccgcatgatcccgtgacgacacataccacgaattataaagccatgattcagacagtacctcagttagtaaaacgctatccggttttgcgagcgtcggctgttaacggatttgtcttgtttggtgtttctaatattttctgggcaacactcgtcttttacttgcaacatcaatacgggtggggaagtcgtgaagctggtctgcttgcgttgctaggtgttaccggtgtgttagcagcccctttaattggccgtctagctgatcgttttcggccccgaacgattatcggcttgggtctagtgttatcaacattagcctacgtagtgttttggctgagtggtacgcatttggtggggttaattattggtattgtcattcttgatttaggtactcaattcgggcaggtcgcgaatcagacacggattcaaagcatcgatgtccatgccagtagccgtttcaattcggtattcatgtttggctacttcatgggtggcgccctaggttcattttgtggcaacgtcttatgggatttagctggttggaacggcgtctgcgggttagcggtcgtcgtgttaatgattggcttttatgcccactttgttcattatccacgggtggtgacacgacaagcgcaacattagcagtgtattagttaatcggtcatgaatcatgattaaaacgtgtcaagtttagattgttgttcgtcagccggtgtgcgtcctattccgacctctggggctgggtgacaattgctggaacgcagccgacgtcgatttgagctaacgcataacccgcgtcatctcaaatacgagtcttattctaagccggaagaaaatcacttccgactaagaataatttggctactgagcattgtcacccagcccctacagtcgggaacccgctcgaatggctaatgaacggccacttaacttagcacaatctgttgttggctattttgatacgggaactttaaacgaaacgttagggttgtattaaccactttgtcgagacggccaattattacgatgttgattgaggaatagtgagacatcctaatatcattttcaccctgacagttgattgataaaattattgtttatgaaaaacaatgacgaatttaccaaaagttgggtacgcacatgtccgccattcgaacactgtcccgactggaaggcgtttcggccaatgctcagcggtgaaattccacttagcaagcgtccttggcttggttagtggaagaccagtatttaagacgtgggcttcggcttaaatctgtgtccaccgcgttccagcaattggcagaaatgcctggaagtcggcgtaggacgaacttgaaaagcatgtttacgcccactcgcacctatttccagcggtttttagctggccgtttttgaacttaaaaaacgacacgttttaatcatgattaatcctaaaatgactagcacgatacctgttgttaagtaggctgttgatgtttgtgtaataacttaatgattggtataggcgctggcagtaggggacagttaattaatatgaagtatgctgatgatgagcttaatgaatattaaccataattggcgttgaacttaatattagtcgtaaatcaattaaaaggattgtatttcagagaaaatggtctaaactctaattattcatgttagaagatgtaacatgaaatctaaataagagggttttgctatgcgaattgaagctgattgtattggtaagttagctgttccggatgatgctttgtatggaattcatacgttacgtgccgttcataattttccgattacgacggaattgatgcatccactgatcatgcaaagtctcgttcaaatcaagaaagcggcggccagtgtgaatgcggctgccggaactttgtctaatgataaggcacacgccattattgcggcatgtaatcagttactactggggcgttacgcggataacttcattgtgccagcgattcaggggggtgctgggacctcggctaacatgaacgtcaatgaagtggtggctaatttggctcaccggttgatgccggcagttgccgttcatcccaatgatgatgttaatcaatcacaatcaaccaatgatacttttccaacggccggtaaaatggcgctttgcatgcaactcccaggactattaacggcactcagccggttggtacaaacgttactggttaaatcgcagcgttatcaagatgccatcaaagttggccgaactcagcttgaagatgcggtaccgacgacgtacgggcggacctttcatgcttattaccaattattcaagcgtgatttgacccgtgtacggcaggcgggcgaacatctccgaatcgtaaatttgggtgggactgcaatcggtaccggcatcaacgcgactcacacgtatcaacagcagattttagtgaaattaaatcaaaatactgatttagatttagtagccgcaccagacttgatcgatgcaacgcaaaactgcgatttgttcgtggaattctctgcggccatgaagacgttagccgttgacctttccaagtttagcaatgacttaagattactggcgagcggcccacaagctggctttggtgaattgaatttgcccgcgcagcaagcaggctcttctattatgccaggtaaaatcaatccggttattccggaggttgttaaccaagttgcgtttgaagtgattggtcacgacacgacggtaacaatggcagcggaagcgggccaattggaattaaacgcttttgagccaattatgttacgggcattgctagccagtgagcagcatttacagcaggccttgactacattagtcgatcactgtgtgcggcaattgacggtcaatcgccaacgctgtgcagatcaagtggcacattcggccattacggcaactgttttggcgccataccttggttacgagacgactaccgcgctgattaaagaagcgctcaccactaaccaagcaattcctgaattattacatcgacgtcgcttgcttagcgatgatttggtcgagcagctgttttcaccggccggactaactcagccacgcccagaggttattgaacaactacgagcggttgcaaagtagccactgttttgcagtgcaatttatggctgagataggctagtgctgaaggttgacaccagccagtttagagccaatggacgtcgcacgacttagcacaacccaaagttagcgcgctttctgccaattgctaaaacgcagtggatccaagtttaagccgtatctcaaatgctagtcattaaaaatgagtcaccagaatgaaaaattctgatggctcatttttagttgccgtttacttagtcttaactaaaagcagcgaggcacattagtgtaagttgaccaaagcaaagacgattggaatggtaacgacacttagaatcgttgagatgctcattagagcaacggctggcccgggatcaccgtggactttgagcgagaacaagacgacgattccggcgactgggcaagcagccattaacactgtggtgaataatgggatgccagtgatacccattagctggaggacaacaatcgccaagtatggaaacaataaattgcgcaataagatgactaaccaaagacgtttatcgagtgtcgcacggttaagtttaacgtctgccaaactattcccaataacgatcatggacaggggtgtgttgaccgaactgacatatttaatagcgctattggcaatcgttggcagttgcagcgaggttacgaaaatcagtagcccaacaacaatggcgatgatattcggattaaagacgatctgtttaagattatcccgccgattgccctgttgtccggtgaagagggtgataccgtgagtccagctaaaaatattgaaggccgctaacgaggcaacagcatagaatacgccagttgcaccgaatagggagctggttaatggaatccccataaaaccggcattagaatatacggcaccgtaacgcataatgcgacgcaaattctggtcagagacacgtttgaatagtaattgcgtcacaatgatcatgagcacataaatgatcacaattccagcaatgacccgggctaacatttgtaagcggtcggctgaaaatgtcttttcaaaggcttgaataatcaagcaaggtgacacaatgtataacaggatgttggttaaatcagttgaagtctgggcatgcatgaagccgagcttgttaacgagcaggccgacgagcatgagaatgaacatcaaaatgatttgactagttagttgcgttaaattcatttacttcagtccaataaattagaatactctcattattgaggtttggcctgaactttgtcaagattcatttaggccggatgatgcgcctggacaatatccacgtgatgtttgagatggggaaaaacatgatgatcagaccaccccatgatggcaccttgagcaattaaggcaaaggccgtcccgaagccaatggcacgcaaatgacctgtggcgaagaatgaaacgatgataatcgtcagaggtggcaaataactggtccactgggcaatgatagcggaaccatgtaaaaaccgaaagcgtaagatatacgataaatcatcgttcggatgctgaattaaattacaacgctggtaaatcgagacggcggccgcaacgcctaatagccccagcacgtttagaatcaagcgtggtaacaggggcagggcgggaatctgtagccaatcccaaaagtagccgataaattggaccaggtaactaaagggcacgatatagagcaagttggagataaaccgccgccgatcaaagtgacctaacagaagttggttgagaatcgtgacaaccacaccgtacagtaataaggtggttcctaatgaaatatgggtccagtcagctagattaacgctggagccagtccagacggcgctacctaggctggtggcgatggtgagcgcgttggcagcagaattcagaataatggaaaagactaaaaaaccaaaacgttgacgaaaatcaggaatgttcaacacgactaagcgacctttcagttaacagtatatgagttattataaccgctttcataagtagatgtcacggctagactcataaaaatatgctatactaattgcacaatagattttacggttgaaggacacttcaagaattcggactacttttgggttgggtagtcagagattgcagtgcccttttttaggaggtttttaatggattacgttggtagtttagcgttgattttaattgttacggcggttgcgggtcacctgagtgtccgaatgggcctacccgcggtgattggccaattgttaagtggaattatacttggtccagccgtattaggttgggtctcagcaacaagttttatcaaagacttcgcggagcttggcgtgattattttaatgttcatggccggcttagagagcgatttaaaattgctgaagaagtattggcgtcctagtttgttagttgcggtcctgggggtcattctacccgttgcggtgattgactggtgtagccaactatttcaccttaacgccactgaaagtttgttcttgggcgtaaccttcgcggccacatcggtttcgatttcagtcgcggttctcaaagagttaggcgccctcgatggtaaagaagggacgacgattttaggtgcagcggtcgttgatgacgtcctggctgttttgattctgagtttgatgatcagcttatttggcagtgaagtcagtggtggcggtagtcatgcctcaaccaacttgggactctcgctggcgattcagttggcgttctttgtggcgctgtactttgtggtcaagtgggtggtgccacatttaatggccgtggggaatgccctactggttccaacctccatcacgctgatgtcactagtgatttgttttggactctcatacttagcggacgcaatcggtttaagtgctgtgattggcgcgttctttgccggtatcgccgttggtcagacggactatcatgaagttatcgatgagcatattcaacccattggtaatgctgtatttatcccagtctttttcgttagtattgggctgaatatgtcattcaatggtttcctgaacgatttttggttcatcgctgtgattaccgttgcggcaattgccactaagctcattggtgccggggtcggcgcacggttggcgggttttaattggttaagcggctatgagattggcgccggcatggtgtcacgtggggagatggccctgatcattgcacagattggttatcaaggcaaattactatcagctgatcgttattcggcagtcatcacggcaatcattttaacgacgctgattgcaccactattacttcgtcaggcggttaaacgccaacgtgaagcttaaagcaattgaaaatcccaacttgtttgcgtgttgcaaacgggctgggattttttaatcacgacattattcagttgttaaacgttgatagtggacttcggcgagctgaccatatcgattggtgtcaactaattcaaagcgctgttgctggtcaattgctttaaataagggaataccatcacccaaaatgactggtgcaatctggatgtagagctcatcaactaaatccgcagctaacagcggcattaagacgccagcaccgccaacaatccaaatatttttgccagcggtacggcgcaagtcttcgacgatcttcgtgacgggggtattggtgaactgggtgcgttcatcgccggtgtgggggtgggaagtcatgacaatattgtgggtcgccggattatatggattaatgagttgatcagtggtttgttccatcgtgtattcgtaagtatggcggcccatgatggcggtatcaacttgctgcataaatgcttcggtgggggcatcgttggcaccagctgttttgaacagccagtccagccgattatccttagtggctaaacaaccgtcaattgaaatggccccataaaactgaactttacgcatgattcgacacctactttatctttagtagtcatattgtaccatgttttccggtcattcacttgctgaactccggtaaaagttcagtaacataattaaataattggttcgaaatgggaggtgggaaactacttaaggtgtcgctgggagcgtgtgaatgctgcaaataatgatgttgtggggctaatgagaatgagtatccacagcgggttgagcaggtcgtggtgatcattgtcggagaagtagcatacgggcaatcaagatgtgagttgaagtaacgattggtggttttcaagggccccaccgtccgctataattggattagcatttcatcacatacagtttgacctaattaggcgagctggcctggttcgtaaacttcccaggataaaaaaccaagaacttcagttatcggaggtaagagaatgaatgcgacgcgtaacgttattattgactgtgatcccgggatcgatgatagtttagcactattattggcgcttaaatcaccggcacttaatgtgattgggattacaattgtttgtgggaacgtgccaacccatatcggtgcggaaaatgcactgaaaattttagatttggctgaccgattggatattccagtctatttgggcgctaatcgcccattggaagtcgcctacacgagtgcgcaagacacccacggcgatgatggcttagggaatagtcagattccagcggtaacggcggtacgaccgattcaagatgccgctggttttattgaagagacgctgattgaagcacctgatacttcgattttagcgttgggaccgttgacgaacattgcaacggtactgcaacgtgatccacacttatttgaacaagtcgatcaatttacactgatgggtggaagttatcggagtcacggtaattgttcgccagtggctgaatacaacttctggtgtgacccggatgcggccaaggtcgtctttgacttgatgcctgttcccattcagatggttggtttagacgtcacgcgtaacatcgtgttgacacccagtttattaacgtatattaaagacgtcaatccagcaatgggggcttttgttgagaaaattacaaccttttattttgactttcattggaaatatgaacgggttattggttgtgtgatcaatgatccgttggccgtggccggaatgcttgacccaacgattctgagtggctttgaaagctacacgacggttgtgacggatggtgtcgcgcgtgggcagtcaatcgtggatgatcatgatttctggcacaacacacccaatagtcaaatcatgacgaaggttgacgtcgtagctttttggcggttgttcttaacgactgtggtcggtgcggctgatcctgatttaacgcaagtcttgcaccaattggtgagtgcatgaagagaataaagacgcgggcaattacgttattggcgctctgcattgccctgaatattgttggcagtaacattgccttgatgttaaaattaccgatttatttagattcaattggtaccgttttggctgctgctgtgtttggaccactgggtgggatgttggccgggggtgccaccggagttatcgtgggtgcgacgacagacctgtactcgctgttctttatgcccgttcaactgctgactgggttagttgctggtctgctatatcggcgaatcaagccgggcacgtggcggtcaaattggtggttagctggtgttatttcacttcccggaacacttttatccacggcgattacggtcatcttatttcatggcatcacgtcgtctggttcgagcatgctagtccaattattattaggtaccggtatgggcaaaacgatggccgtcttcttgatacaagtgggaacggattatctagatcggtttatcacggtgtacgtggtcgcacttgtttaccgcgcgttgcgatataaattgccgcaagctaattagtcgaacggatgacttggtgtcggatgaccaatctaagcatgtttacgctaactcgcactttttccagcgggccgaagctggctgtctttgagcttggcaaattctagttttcgattcgtagtatctgatgagtcgtgtgaatatgaacagtaaaaatgacctcacaggaacattcctggcgaggtcatttttactgttatgaggttaaagtgcagtggtcagtagcactacgagtcgcggcgactcatcttaccatcttcaatttgatagaccacgtcacagtcatcaatcagccgttggtcatgggtcaccattacgatggccttttggtgctgatgagcttcgttggcgaggcgcttgacgacgtcgatggagcggggcgtgtccaggctagcggtcggttcatctgcaagaatgacgcttggatcattgtaaagagcgcgggcgatggcaacacgttggcgttcaccaccggagaggtcacttgggtaggcatcccgaacttcagtaagggctaactctgctagtaattcatcggtgcctgcttgatcaaatttgcgccgggccattttatcgacgagcttgaactgttcacgaaccgtcaggaatggaatcagattggaactctgcaagataaagccaatttcattgaaacggtaggctaagcgctgtttttccgtttgattcgatagtggttgtccgttcagaataacttgaccacttgttggcgtttgtaaaccggcagcaatcgtcaaaaaggtggatttacccgagccagaggggccgataatcgcgacgaattggccagcactgacttcgaaattggcatcagtcaaagcgttaacagcggtatgaccgtgaccaaattgtttattaatattttgtaaggctaaaactggttgactcattgatatcatcctccttatccaatggcaacgacggggtcaatcttggcgacagtccgccatgagagtaaggcaccgacgactgcagctaacaagagagccacactataaataccaaattgtggccagtcaatggcgaatggtaatccggcgggcatgatttgcgcgaggcctaacgtaattagaaggccgatgccgataccaatgattgccatgacgacactttgggtgagtagggcagccaagatgtgtttggtaccaataccttgtacttttaagaccccgaacaaggcttgtttttgaagggtcagaacgaacatgaaaattccaatcacggctagggcaattgcgaacaagaagtaaatcatcgtgttgagtgtcaactgctcagcgctgtatcctggtaatttttcaataaacgtggcaattgataaacgttgcatgttgccatgatgttgagtcttgaaatgactctttttagtcacaaaggcgttgaccggttgttgatcgccactggtgatgggattacctttgagacgattgagcgtggcaacgtccgtgtagaccgttggcgcaatactataggtactagctttgaaagtaccgacgatcgttaccttttgatcagtggtcccaatgcgaactttctgaccaatccgatagcctttgtcttttaatcccgcggaaatcaataattgattcttgccgttgattcggtgtcctgagatgacttttggcatcagaaaactatcgcgagtggtcccaaaagcgctagcgttagttttttgaccattactggcagttcgtaaagtaccggacagactagctaagggtgcgacgtcctgacctttgattcgatcttggtctgctagttttaattgggatgctgacagtgtctgattcgcatcttcgttcaaataaactgtttgagcatgccactggtcaacagcctgacgattaccattggataacccgttagcaaggcccgctaacataaagacgacgagggcaattagtagcaaaaccccgctaagtagcccatatctgagtttttcgtgggccatttcttttaagcctaaatacatgtcaattcctcccttttaatttcatttatcaagtgataaatcaatgtggtaatcgtatcacgttcatttttgtaaatcaaattttttatttaattaccaggctaaattatttcgaaatgggtaccaaggctggtatgattaatttattgaatagagaggcaggtaattattaatggtgaacaagcagttcaatcatcgggccgcagttattgctggtgtgactggtggtgtgatttctggtttagttaagttagggtgggagaatatcctaccgccacgaacgccacagcgggatcaaacgaatcccccacaacaattattgcaacaaattgggattcccgccagcgttacgcatgcaacgtattcatattctggtcatgatttaccaggtgtcagctatgtcatgcatttcggattctcaacgacgtttgctgtggcctatagtttatgggctcgcaagcacccccgggcaaaaggtggcagcagcgcgttgtatgggttaggtatctggacagcctttcaccatggtatcttgccagcactggggaccgttcccgctgcgaaggatcaaccaatgaccgaacacgtgtcagaagccattgggcatgttttatggatgtggaccgctgattgggttagtgccgctgtctatgaccggatgacccgttccaaatagcggtttaaatcggttagtgagtgacgacatgatgaggtgttgtagccgcagccgttgaataaagttgttgcttgaaaaactagcttggttaggaatgattacaactgctaaccaagctagttttaattgtcgctattttggttaatgttcggattctgatggtaacggaaatagtgattcaccgcgacaattacgtgattatgaggaaagcaactgagattaacgtctattacaatgggaccatttgattttaatgattgattttttaatttaattctcatattgactgaaaatgtgctaaaatattaatattgtgtgcaatatttcataaaaacatccataaatgagaatggggcggaagtagcttggaaaagcagggaaagatgaagcggtatcgccagttccgattgagcttgggctggcagatcttaattgggctagtgcttggaattgtattaggggtcgtcttttatggcaataaaacggcgattactgcgatgcaaaacatcgggacgatgttcatcagtctgattcaaatgatcgttttaccaatcgtggtggcatgtctgattaccgggattgctaatatgggcgacctcaaaaagttaggtcggattggtggtaaaaccattatctatttcgaaatcatgacgacgattgcgatcgccttagggttgttaatgggtaacatttttcaccctggtgactatatcgatattcatcaactacatgcgtcgaatattagtcagtatgtgcaaaccgctaagacggtctcacacaatggtatttggtcgacggtcatgggtattatcccgactaacgtctttaaatcattgtcagctggtgacatgattccagtcatcttttttgccgttttctttggtttagggacggcggctattggcgaacaaggcaaaattattctggactttatgaacgctgtcgccgaagctatgttcaaagtgacgaactgggtcatgcacacggctccgattggcgtctgtgccttaattggggtcacggtcgctgaaatgggcttgaaggcgctggccccgttaggctatttcattattcttgcttatattaccatggcaatctttattgtggttgtgatgggcattgttggtaagttattcggtttaaatatttggcacctactacgggtcattcgtgatgaaatggtgcttggcttttcaacggcgagttctgaagcggccctgccccgcattatcgataagatggggaaatacggtgttagtgaaggaattgtctcatttgtgatcccaactgggtatacgtttaacttggatggctccgcaatttatcaatcgttagcggcgcttttcttagctcaggcttatgggattcacctgtcactcagccagcagatcactttattgattgtacttatgattacgtcaaaggggattgctggtgtgccgggggcttcgtttgttgtcttattggcgacgatttcaacgattggcgtgccagtacaaggactcgcttttattgcgggaatcgaccggctagttgacatgggacgaaccgtggttaacgtggtcggcaattcattagctgcggtaattatcggtaagtcagaacatgaatttgatacggccaaaagtgatcagtatttagctgagattcgggcggggcatgcgcgcgcaattacgaaataattgaaaacagctctgtcagttagttctgcattaataatgcgatggcgatgatcactgatgattgataggcccaaaagttgtatttcagaaattaatttctgaaatgcaactttttatttgaaacaaaataatttttgagcgcactaatctaaagcactcgaaagtgttgaaaaaaactagtatactaaagctactagctagtatttaagtttgtgggatcaacgtaattgccttgcgttggtcctttttatagtctacataagtggtgccttcatcaatcatgacgtagataattcgtaataatttatgagccagtgcgactagcgctttttgcgcggtcatgcgaccgtgcaatcgccaaaagtagtcttttaaaccggtttccttggactgtttggcggcaagcgccgcgcttaccatggctgatttgagataaacattgccatgtaagatatgagcaccatgtttgataccggcagattcataattccccggacagagaccggcccaagaagctaaatgatgagcatctggaaatggacttacatctgacccaacttcggcaatgattatctgagcaatccgttgactgataccaggaatgtcttgtaggcgaagatacaaatcattaaattccataatttgttcatcaatttgagcatccagttcagccaatacccgcctaaaatcagcgagtagttccatattcaagcccaacaatctccgatcgttgcgtggcagaatgccatccatcgcagcaaataattgttcaacactagcctttatgcgggtgtggcgacattttgtgatggcctgtaaagtgatgacttcaccatctatgagtaacttcagcagtttaaggccagttccgttaaaaatatcggaaatataggtcgttaatttaatgtttgagcgttgtaaaagattatggacttcatttttggttgcggtcatagattgggtaatcttcttacgtaacctagttgattcgcgtaatgcttgaatcgactttggcgggacaaaacttgcggaaactaagccgtaacgcgccaattcggatagccattcggaatccttttgatcagtttttttaccaggaatgtttttaacaattcgcgggttacacaggatcatcttgaaaccgaagggttccaagatttgccaaaccggtcgccaatactgaccggtactttccattagaacttgttcaacatggcgttgcttaagccattcaccgcaatctttaagccgacaagtaatggtttcaaaacgtttcgagattttcttaggcttggcgttagccaagcccaccaatatagaaactgtaatctgtttttgatggacatcaataccagcaacactttcagcaacgacttccataaaactcacctcctaataatcttgaaagcagtaccttcagtcattgagggttgaaattttatttacgtgtacgaaacgacaattgattaatctcatgaactgaaagccatcggttttttatacgggctaaagcgagcaccaataagcacacgatgaacacgaaaccgccttcgcagtcattataactgagaaggcggttgtttcatatcatgattacgagggtagagcgaagcggcgccctcagatagttttttatgatatcttattctggttacagcaattacttcagcgattaagttatgataagacctataggggaggatggcgatcggatgacaactgatttttcgattgggcaactcgcacagttatttgatatcccagtggcgactttacgctattatgacgagattgggttattgacgccggcacgagtcaatccgcatagtcactaccgatattatgggacgcctcagttcgaacggttgagtaccattaaatatttgcgagcactcggcttaccattggctacgattgccgatttttttgcggcccgtgaactgtccaagctgacgagtatgttaacgacccaacagcagcaggttgaggcgcaattgcgattgttaacggcggtacaacaacggatcaatacacgcttggcccagattaaaacggcccaaagtgccaattttgatgtgactgaatgcgtgacgttacctgaaagagcgatggttgctttacgtcagccttatcgccctcaagatgatattgaacttgttattgctaagctacgcgcacagaccggcgccacgaacgaaatctttctcggcaaggttgcgctgatgctcgaccagcaagccatccaagccggacattttgaccgctatgcgggaatttgtttattatttgaaccgggtgatacggtgccaccccatcaagaacacttggcggctggtagctatgcgcagcggatttttcacggcactcatttggatgccccgatgcagtatcgacaattgttagcggattgtcgtgctcacggctggcacgtggcgggaacagctattgagacagcactgattgattatgggattacagatcaggttgcacagtcggtgacgcagatacaattaccaatcaaggcttgaccctcaagtaactttagactttatactaaatgataattaattattttaaattgaaataagcgctaaagattaagctattgattaggagtggcgatatgattggaacgatttttaatacgagtatgattttagctggttgcttggtcggcagtatctttaaaaaaggaatcaagccagcttaccatgcgatattattacaagcactagggctagcggcttgtgtcatcggcattaatgcggtcgtgcaacggatgccgcagagtaagtacccggtgctttttattgtgagcttggcgattggtggattaattggtcaagctttggatattcaagggcattttgaccgctgggtgggccgtttggcgggtggcaacttagcggaaggcctagcgactgcggtgttactgtactgtattggatcgttatcgattttggggccgattgaggcagccttaaagcatgattacacctttttgtttacgaatggcatgttagatggcatcacgtcgatcgtattagcatccactttcggatttggcatcgcgattgcggcgggcgtcttgttttgttggcaggggagcctgtatgttttagcattaattttgaaaggtgcgttgagtgcagcgttactgaatgaaattaccattgttggtggtatcttgattctagcatccggcttaggtatgttgaaaatcaagcaattcagtacgttgaacctattaccagccttgctagtgccaccaatcgtaattagcgtgatgcaattattttaactagtgggccaatggtgaagtcaattaagtcttttgattgataaagtaaaagccaccaacttaggacaatcagtgaaagctgatcattttaagttggtggctttgtgtataatgcatcgatttgagagattggcattaaatatggttaaaacggactgtttaactggattgttttccgtcagccggtgcgcgtcctatgccgacctccggggctgggtgccaattgctggaacgcagccgacgtcgatttgagctaacgcccaacccgcgtcatctcaaatacgagtcttattctaagccggaaggaaatcacttccgactaagaataatttggctactgagcattgtcccccagcccctccagccgggaagccgctcgaatggctgatgaacgaccaccgaacttagcacaatctatcgttggctattttgatactggaacttcaaacaaaatgttaggtgcattagcactttgtcgagagattacatcttactacaccaattcaggattaatgagctatctcaatatcactttcagtctgacagttgattgacaaagttattgtttatgaaaaacaatgacgaattcaccaaaagttgggtccgcacatgtccgccattcgaacactatcccgactggaaggcatttcggccaatgctcagcggtgaaattccacttagcaagcgtcctttgcttggttagtggaagaccagtatttaagacgtggtttgcggcttaaatctgtgtccaccgcgttccagcaattggcagaaatgcctggaagccggtctaggacgcgccaactaagcaattttacgcttactcgactttttttcagcgagcctaagctggttacttttgatttaaaaaacagtccgttttaaccataattcacgccaacacgcacaatagatgtcaaagtaagacaccggttagattaagtggtgtttgatgctgaagagttgacgattgcgttccagatgacggtgaatgtgatcgatgaggacgtcgtgcgaccaatcggtagttgtgttaagtggcggaacgggaaaacgttcatcgatatcgattgtcggtggcgtgatggcacagttggcgactagggcgatggcgaggctcgtaggtgtgtgctggtacatgaggtcatttcgaatcgcaaacctgatgtgctgctggttggctagtttaacgtagcgattcaggatgtcttcatctagcaagccatgtaggagtagctggtaatcaggatgggccgccatttcactttttagttcggttgagtagtcacgcatgagtgcttgggtgaaagtaatgcccacatcgattcgttcgtgaaacgtgccaaggttacggtgttgttcatccggatgtagtacgggggccccgaatattgcggattgtaagtgtttatccatttggtcttcagaattagccatgccggtcaggtcctttcacaattaaccataagatttaactgcttttactactattgtaataaagaaagcgctttaatcaacataaaattttctaaagctgatcagaagttaaaactttggatgccactaggcttgaaacggatgacagataatctaaggacgcaacggatttgccggggccaatttaatgctgttttgaaaacaaggactcagtgcttcataaaataacgaaggtgcccagaattaggaaagttgacttcatcggcaaataacgaatattcaaggccattttgggaaaagccagcctcggccagataatctcaattataatctaagtaacggtcagggctaattcaacaaattgataataaggttactaatatatcaataaactgattaaagcagtgtgctgcttaatgattaaccaggctaaccttaaaccttgtcagcattgacttacggctgattatacaagtcttttttttaagattgtaaaggtgtattattgattcgtccatggtatgatactacatagtatgttagtaaagtagtcaatcaaattaaaagagaaacggatggtaacaaatgccaagacatttacggagacggcgccggtcctggacgctgatcataattgccatggtgcttttgggggtcattggatttacaagcacacaagtttctgactggattgatgcatcgtttacaactaaacaaacggatgcagctaagtctagttcccaaacgaagcccaagtcggtcaatcaggtcaagttggacgtcccgctagtgaatcaaatgacaacaccacgtttatacaatggttgtgaagtcacatcgttaacgatgttgatgaattacgcgcatatcaatgtcactaaaaatgaattagcggcaaagattacgagtgtgccactcacttatagtgacggcgaacatgggaatccagagtatgggtttgttggggatattactggtaacgatcctgggttaggtgtctatcataagccaatctataaattggcgaaaactgagactagtcaggtgaaggacttaacgggggcaaactttgatactgtgattgaacagttagaacaaggacggcccgtttggacaattacgacggcttcgtttgcaccggtcagcacgatgcaaacttggcagacaccacagggctccgttaaagtgacttatgatatgcacagcgtggtcattgttggctttaaccggactaaaaagttgatttatattaacaatccgtacggagaaaaacagcaggcagtcagctggaagaattttgaggctgcttataatcagatgggcaagcaagccattgttctgacgttaccacattagttagttaacaacatgctattgtgaaccaattagtttaagcaactaatcttggtcaagatgagccaaaatcttgatgagggttagttgtttttttgtgacggtattttcgaatgaaacggttgtaatatcccgtggtatgggtagttcgggcaccggaaagcgggtgagaaactgctaacaatatcatgattgtaaccaaactgtaattcaaatatcagcctttccagagttgttcataatattaaccataaaggggcgacgctttgttaacaagctgtaactgaattgaaatcgaattgacgccccagcccattaaaaatagcctattattggtagtataagaatgttaaagttatgggtatgtcataaactgcccttgacagtttagttgttggtgattgtgggaatcaccaacaacttatgatgataatttttttaattgcggagcacagtatggggagagggaccgcatgatggggattaaaaggctcagttggttagttgaaacggcggtggtcgccacacttggcatgcaaattacggttcaagcacagggacacgcggtggtcgatatttccgagtggcaaggacagctcagcccaagtcaggtgcaggcgatgaagtcgcaagtgctatttgtgatcaatcgtcgtcagtatggtttaaattatgttgaccgggacgcagcgaataatacggcattatatgttcgttatgggattccatttggtgagtatgatttttcgcaatttacggatgccgctagcgcgcgccgtgaagcccaagcgttttatgcgcgctccaataaagctgcgcgtttttatgctttggattttgaagttaatacggtacgttcagaatcaactaatgcggcagttgcggcttggtatcgtgaaatgcgcgcattgactaacaaaaaactgatcttctattcgtatgcttcgttcgcactgacgtatgccaaccaagcgcggcaacggtttgatgcccagtggattggtgcgctaacgcccaacccaccaatcatttcggcggcgttatggcagtataccaatcgctatcatttagctgggctagcggcaccggttgataatagtcgggtcattactagtgttcatcccgtttcgtggtggttggggacgacccgtggcgcacccggtgttgcgattaaagctcaaccaagactgaaagttgtgcacgatcgccatttgactatgccggcccacaatcaacagcatggacgggcgggccaagcagttgtcgccattaagaggccagcagttcagccagctgtgaagactcggccagtgcagcagaaagtggtaagcaataagtcgcgttcgcagactgtggcgcgcgtcaaacggcggtcattgcaaacgatcagtgttaacagccatcatggcaaaataactcagcatcgcgccattcgacgccgagcgactcagcccaaagtgataaaacttaaagcgacgcgacgtacaggaacacagtttaaactgaatacgtccaaagcaactaaacttcggcggcccggtaagagtattcgaacaaaaccggtgactcgttcaaaagggcgaacgcggcagcgacttacgcgacgtcaaccgtcactggggcagcgagtaacgaaaaacaggcaataccgccgccgcgcactacgagtaacggtgcagcggcgagggtcgacgattcgtcgtgcaccacgtcggcaacgaacacaaatacgtcccgtacataacacttctcgggacaagcgaggacttagctgattgcatggctgtcgctcagttctcattatcatggtagaaaaggtaattatggttaagtaaaatcggtcatttgttgtagaaattaggaggatatttttcatgaactttaagcgcaaaattcaattaggaatcgccactgcaactgggatgttggtggtcggaattgttgccgtaccttcagtaacgaatgtattacacgcggcttcagacagtgttagtttggttagtcagacggcagcgcctacgaccgtcaaggcaaccaatcaaacagtcaaggccatcagtgcaagtgggaccaagggaaactaccgggtgaagtacgccaaagctgggactagttcgacgactgcgacgtatcaacagacgaactacaatacgaaaagtgatgccagcagccaagtcgattacttagcgaatacgcagggtcagcgtacgacacttaattcaggtacagcggcaacggttcaagggacgatgggcaaagtgtatgttcattggaacacgggtagttggtcagtgacaacgattgccaatacacaggacgttgctggtaatccaaccaagtttgctaatcaggtcaataatcagattcaaaagcaagatttgacgagtaaaaatgtcacgagtggtgccgttaccgtgtacgataccccacaaaacggacaggcaaactcagttcaatggcaaaatggcaaacaggttgctaaggttcaaggccagcaagccaataccgttatcaaaattgcggcggatgctaaaaattaagtttttacctgggagctcaatgaatgagtgccagtagtctggttatatcactgtgtcgacgtcaaccgcattcacaagccagacactatggttagattagtgggtttaatgcgatgttttgaccgaaataggattgacttttggcagtggagtgcttatgatgttaggtaataattaaaaagtagtgatcgttaattagtagtcgttgacccaacagtctagcgactcggtgggtggtgcgaaccgagctgtagtcaaagatgaattacataacgtgaactgccattggccggatgatatccgttactaatcaatgagcgatcacatttggtgataacttgggtggtaacgcggaaaactcgtccctgttttgatgacaggagcgagtttttttgtccagcgacaataacgaggaggactaacatgaacattatcgatgatttaaaatggcgtggtgccattaaccaacaaacggatgaggccgggttaaaggaacttaccgaaaaccaatcagtctcactatactgtgggattgatccaaccggggatagtatgcatattgggcatttgattcctttcatgattctcaaacgattccaattggctggtcatcatccctacgttgtagttggtggtgggacgggtgctatcggtgatccatctggtaagaactcagaacgtaagttacagaccatggatcaagtgaagcataatcaggatggcttaagtgctcagatgtacaagttgtttggtcatgacgaaaacttttcgattgtgaataactacgattggttatcaaaaatttcattactagatttcttacgcgattatggtaagttgttcagtgtgaacacgatgctgaacaaggaagttgttgcaagccggttggaagtgggcatttcatacactgaattcacataccaaatcttacaatcagttgacttcttaaacttgtaccgtgctgaacacgtgcaactccagattggtggggctgatcagtggggcaatatcaccgcggggaccgatttgatccaccgcttagaaggcaatgacgctaaggcttacggattaacaattccattattgttgaaggcggatgggactaagtttggtaagactgctggtggggccgtatggttaaaccctgaacggacatcaccgtatgaattctatcaattctggatcaaccaggatgatcgagacgtcgtcaaatatctcaagtacttcacgttcttaagtcatgaagaaatcgatcgattggccgaaacggtgaagactgcacctgaaaaacgggaagcacaacggcgcttagctgaagaagtcacggaatttgttcatggcaagcaggcggtagttgaagctgaaaatattactaaggcgttgtttactggtgatgttcaaagtttaacggcggacgaaattgaacaaggtttcaagggtgtgccatcagcagacgtctcagctgaaaagcaaaacattgtcttgtggctggttgatgctacgaaattcgaaccttctcggcgtcaagcacgtgaagatattaaaaacggtgcgattcgaatcaatggtgaaaaggtgacggatgtcgaggccgagattgatccgtccgcagcctttaatggtaaatttgtcattgtacgtcgtggtaagaaacgttacttcttggcacatgttaagtaagttaatttagcaggtggactggacccgttgtggcccagtctttttattattattacaagtaagaactggtgtaaaatttatttaggtcacattaataatgtgtgatcattgccagatgaaaatcaattgaggagatgaaagttttggtgggggttaaatttaatacacggacgattgcaatcctggggatgttgatcgcacttaatgttgttatttctatctttttccatatcccaatcccgatgacacacggttatattaacttatgtgatgcgggaatctttattgcagcactgatttttggctggcgtggtggggtcattgttggcggtgctagcggactattactagatttattgctagggtatccacagtatatgtttttctcactactcgttcatggtttagagggcggaatagcaggatatcttggtgctagcaaatcacatggtcgacagattgcagcgataattactgcggtagtggtgatggtggtcggatactttttgtcagattcgctgttgtatacgatggcaactggattggttggtgtaccgactaatttagttcaagctgtggttggtggtatcttggcattcccaattgttgcgggaattcgaccaatcgttaaacgtcatttgaatttttaaaattagatgtgctggcttaagataagcgttcgtcgtgcttttacgggcgcttttttgctgtctaaagggaatccttaattggaaaacatagtgccatctcacaatgatgttaatcgatgacatataatgtagtaattgtgtaattgacgacagttttgtgccgttcttttcataaaagtgaaaaaacattggattaattgttgacagtttcataactggctggtatattagtaaacgttgctgctacggcagatgcatctcaccaccaaataattattgaaattagttgttgacaacttcttcagtaattggtaagatagtttctgttgtcgcaacggcaaccacgacaaattaatcaagttacttcttaaa

SEQ ID NO: 6 - DNA, 41908 bp, Lactobacillus plantarum
tcaaaaaccaaaaagtgaacctaaacaacgggtgagattagcaaaaaaaggagatcataaatatggataacgaattagcagtcattgggagtgaattaccagttttgcagactaaaggaacctataagtatttaaaagaaattactggaaatgggtcttattatcaagtggcctggcaaaaattagccgatggctacgttgccctttatggcacgaccccggttcaaatcaacgtagcccctatattgaatgatatttttgaagatgaggaggagtagacaatgccgagtaaagcagatgttaaagcctggaaagcacaattagtcgcccaggctgaacaacaaatcctaaaattaaccgatagtgaccgatttaaacagtacctcaataccttggctaaattccatcattatagcgccagaaacattgatttaatttatgcgcaaaatcctcaagctactcaagtcgccggttttaagcaatggcagacggcttttaaccgcaccgtcaaccggggcgcaaaagcgattcggattgcggccccgattattaagaagttaacaccagccgagcaaaagcgacttgataccaccgatgaacgcgccattgtcggttaccgttatctacccgtctttgacgtgtcacaaactagcggtgaaccagtgttaagttctaaggattttgtcaaagaaaatttagccgatcatcagaatgtaacgagcttgtataacgcgttcaaagattatttaaaccagcaaaccgaccttaaagtcagtgaagtgcctttagcgaagctaaatggggctaaggggtattttcaacccagcactaatgaaatcgtcattggtggcgatgagcccgacaatgctttgaaactaaagacgttataccacgaatatgcgcatagccagctacacggcttaaaatcagcctttaaagatcggccacgagcctatcaggaaacccaggccgaagcggttgcatatgtcgccatgcaaaacattggcgttgataccagcaactactcactcggttacgtggccacctgggccaaagataaagccgtaatccatagcgctttaagtgagattcagcaagttagtaacaaagtgattgaacttagcgatggcttaaccaaacaattaggcttacaagaagcacaagaaggacctgagcacgatttaaaaaagctatcagcccaagcacttaatcagtcatatcaaggcttgcaacaacaaattcaacaggcaactagtccacaacagaaagcgcaatttaaaaaccagttaaacgatgtgcaccaagaaatcagtgagcgaacacagaagcaactgaaatcctttgctgaacagaatccagaaatcaaacaaccagattctgaacctgatcaaagcctaaaacgttagccagtttttaaaggtcatgctataatggagacagaaaaaggaagccccgccgaaaacaggacttcccacgcaagccgcttcaaaggcggtggcgaagttaataagacagcattaagctaccctgtaactggccaaagttacgcagggcggcttttttatttgtggtgcttgtcgatatagctgacgtgccaaacagcaacatcaacgagcgtgtctggaagacgctcattgactgtgaaaccttcctgaagattattccatgttcccatgggcctcacctcacaagggaaaagacagccaccgcccttaaaactttagagtcctaatatacttgactttacgtagaaaaaacttgcttgcttaatccattatacagcggaagctagcgatcaaccgactctaaccaaaaactagttttgagttaatagccaattgtttgcttgaacaattggcctgttagtttgcacttcaggtttaattttattattgaagagtacttgcccattgtttttcttgattttttcagcagttatgtttacttgggcaccattatacatggtgtacgtatcgttgatactggtatacccagcagagttaccaccaaaagttttaacgttgggattggtttcaagtgctaaagccgttaactcgcctgaactagcagtccatcgattgagtatcaccgcaacaggaattcctgtgattttttttaccttaccgaggtctatcttagttcccatgttgttagtaacactcccttggaaggttacactcgtagtcttttttgccgcgttaactacttcaaataattttccattagggataactggcgaaattccagctaacattgggccaatgtcaccacctaggttattcctaagatcaatgataatacccttatatgttttactagtcagcttataataaattgtgtttgcgtatcttttcccttgtgatgatgatccattgaattctggtaagtggacgtataagatattatttttaacgctgctagttggtgctttgtattgtgaaacttctttttttacttctgatggagttatcaaagaagagtgcttaccacccttaattgccaaggcttgttttaacagtggataaatttctttgtaggtatgcttatttgaaatgtcattgcgaatctctgtcatcctatttttctgcgtttgattttctgtatagatccctgtggacgatattttattaaaagccagcatggcgtctcttttaggggttggtgggactaagtagaagtcaaagttaggtccatactgatatcctatgtatattcctccagaaataatcactagcatagttactattagcgagataattaattttttatgctttttcaaataactcactccttaatccttaagatactcacaacataattttaacacattaggagatatgcctaaccatcatgggatatttgtaaatgagttagcttcaagaaaggtcgctatcttacgtaatcgctactccaatgaagctcaccacaaaaaaatatcagacgtggttttctggttgccattgccagatggaatcagtgttctttcgttcaatacgggaaaacgggcaatgtaacatggtaattgcgttacattcgcgagatttctgctatcttaaaagttaaggaggactattaaattgcaatttgctaatgtattacggaaaaaaagaaaagaactgcacttaacccagcaacaattggctgataaattacatgtgacacgtcaaacgctatcacgctgggaaaataatttaagttatctaaatttagacacattagtaaatttaagtgaatttttagctgttcctctagatattttactcaaaggtgatggaaatttgatggttaacaaaattagtcaggacgtacgagacaaagacaagtataaacgctatttgatgattgtttcagcgatctttattcttatatttttatggttaagtgtattaggatacggacgtgctagccaaaatgaatggattgatcgtttcaatccttttttaagagttcaatatggttatgcggtactacctaaccaggttccagagaagagagaaaagacaactatcattgatagtgatggtaaaaataaacatgttgctgctgttaaaaccccgcagcaagttgatgcgtttgtagctgatgatccttttgggagtggtagttggctaaagttttataccggacaatatagttctaaacagcgttgggcacttgttgctcataaaggctcctatgtttcaaatgttcgtctagtctctcgtgcgcaaattcctctaatgatgcgtgaacaaactgggaatcattatgtagcttacgatgctcatgcagaaagacggattactaaacgatttctgtggtggccgttcaattaaaaaaattagtattgattagtcacattctgtatatgaagtgttaggttattagggtatcgactcattaccggtgtaagacgaagcctagcaaataaagtgttaagaaaaatgcggagagctagaattttatagcttctccgtatttttaaaagacacattgcgaatttcttgtagtgggataaaccgatcagcgtcaatcacaatatcattggcattgtagccatggatcaaggtggtgatatctggccaatgacggttgttttggtcaaccgtttttaattgaagggtcactggttgctgacgctgatatgcgtccgccaatacctctgtaattactgctaaggattgttgcggtcgtggaacgtatatttcattcaactgctggttctgttggtttaaagcggcagtatgatcggataaatagaagccctgccatttcatcatgccccggtcatgataatcatgttcaaaaaaacgcttaaccgtgcctaaatcaaattcttggttattcaagtggcacccgctttcgttgaatcagcttttgacttgccggccaccgttctcctgtaaagccgacaaattcgatcgttagctttatatcttgtcgtaatgcttttaacagcttttctaaatcagctaaatcatagtgtgctaatttatgtaagggaacggattgcaagcgctcgttagcccgttgactgttaaaaaacagattataggtctgatcgtaggtgtcattagtcaacattaaccaatagcgggtttggggacgccgcttaaacaataaggttaaccgccccttaataatctcgatatcgctattcatagctattgcctccattatgtccgcccactagtgaagcccgcttgatagcggtgcctccctttaataaactggtcgcgtaaactagtttggtgaacccaaattgccggtgaatttcatcaatcacttggtttaaccggctacggcgaatttggttgtgcggggtttcaaataaattaagttgttggccggagttggcacttagtttactgctataaacgccaatattccggacagcttgaccgtcccaattctgacggaataaccacaataattgttgcgtcaaaacttgattgtcgttagtcggctcaatttttaaagcttggtgaaagccaccgcggccatctgcttcggctgcggcataggaaaacccaatgcttagcgatagacaccccgccagtttatggtggtgccgaagccgcgccgccacctgttcaccaatttctttaatgaccgtttcaatttcggcttggttaaaatagtcccgtggcaatacttgcgaattacccaggctagcttctttaaccttagttggttccgtaacttgcgcgcgatcaattccccaggccgtagcaaataattggctaccaatgacccccagctgctgtttgagtaaataagggttggtgtgggctagctcatacatattatgaatttgaagccggttcaaacgtttagccatacgggggccaatcccccaaacgtccgttaattcgtcaattgaccaaattttatccggcacagtttcgtaatggatttcaccgatcaattcatgattatgtttagcgtaaaggtctaaggctaatttagcttgcaccggattgtcaccaatccccacggtggtatacaagcctagtttttgccgaactgtcttttgaatcaagcgcgccacttcgcgaacggaattgccaaacagccgccaagtatgggtcatatcaagaatgctttcatcaatcgaatacggccaaacctcttgttcagtggtaaattgatgaaaaatctgattgatctgtaaattgcgttgaatataaaggttcatgcgcggtggcacgacccaaagcctgggatcattaggcaaatcacgttttcgggagacattggctttaagatgaaatacatgcttagcttcgggtgacgtggctaaaatgagcccaccattggtattttcagcttcactaaggaccactaacgggacttttaagggattaaggccccgggcaacggcttcgcaactagcataaaaggacttgttatcgattaagaagaacacgccatgcggttcatcatcaaaaaacatttagatcacttccgttagcttttacctatattgtagcacagaaacgaacatacgttcccttaaattgttagaaagctgattaaaaatagtcgaaagtcaattatagtcatgctataatgtgagtaagaaaaaggaagccccgagtgaacaggacttcccatgtagagccgtttaagacggtggcagattttaacgatatttaataaccgctagcttgccagagctaaggcggttattttttttgctgacttttgatcagctcaacaattaatgcgattaaggctacgataaacataccgaaagccagcattaattgtaaagcgtccgcaacggacacttaggctactcctttcgttaggatttatgggctttaaaggtttaacaccataagcaccacctccgattggaaatagccaccgccttaacttctctacaaagaactattatacagggactctgtatcactatccaagttttaaaacaaatttgcctgatcgctatattactagtgagaaccaatttaaacggattaactttcagggttaatccttatattactagtgggacacggacaaaatttgaaagaaggctttaaaacttggtgacgtagaacattaaggcgcttgataattctaaaaataataatacaaatgcaaacaaatatgaaagaagattttataatgttgaaagttatacaattatttataggtcaatcatgggaactaattttaaatatcgtccaatggattagcattaacatatcggtaggttggttagcattcggattagcagtaataacatttttaagaaatcgtcacaggaagctgagacaatcttttgaatactcctcaggaagcaacaattttgaaacagctattttcctatataatgacagtttaggaactgaagcgtctgaactgctaggaataatggttacagacaagaaatcctatctatatcgaaagttgttgccatacatcattcgagtaaaacttagattgtgcaaagacaacaatcgtaagaccacgcatacgacaaggtcttgggcatatcgcttatttttattgtttatagataagataaagtctaagaactataaaaagcaatatgaagataaggacttatatccttaccttcaaatggtgaatatccaaaatggcgatgaaattgcggcggctggttttattcccatcaaaagtcacgaaatgagaactattgttattcctaaagggcgctttttagacgcagttaagaatcgtcttacgtctaattataaagcattaaagcgcttcgttaataaaaagcccgtttatatttatttcatatatcagaccatgagtggcacagtgaaggaatttgtcgttgaaacaaattgtcaagactccttgggaaaagatttagatatggaatatttagcaaaaattcttgctgttcaagataaatataaaacaaaataagttcatatcaaacggccaatagggtatatcctagtggtcttacttgtctgcacgagctgcttcaatttgcaagagttcaatagcattgtccaaaattatcaatcaactagcaaacagaggaccttaagcaaaactactgaacattgcttaaggccctctgtttgctacgtattatctaagtttatgcattgtttctgccataatccaatgaatgaattttaaattactgatgaagaatataaacattatgactacaacgataatccattcccatagcggagcttttgttaatgtgactaagctgtataagtaaaaaattgttatgggtaattcaataattgcggttatagctccaggaacataagcacgtttattaaagacaaaaactaagtgcatgatcaaatgaaacagatacggtaaaattgcagtggcaactagtaatggtgagcccatgatataggcgactgctgcgagcagtaaataaatacaaaattcttcccagattccagccgctaaaatatctgaacgattcactccaccaaacagcacacgcccgttaattttgggattatgatctttcaaccaatatgggacaaatactaactcttcaaaatcatggaacataaataacaatggcaatatccaataagaactaaaattaatcattttatggccctcccgctagtattatattatgttgatgcgaatctttgaatataatggaaacatgtgccactgaaaggagtttttgtgccatgtctcggacaatgattattgaagagtctaaaaatgcttttattgaggccttgtttcaactactgaaaagcgaatcctttgaacatattacagtcaaacagttgacattagaatcgggttattccaaaaggacttattatcgatacttcaaaactaaaacaaaaattttagatatagcattttgtaaatatctcactagctatcatgattacttactaaaatcttccattacaccggatactatccctaaacattttcttgaatttatttggccccaccatgacaaaattgaattgctagctaaaaatgatctcttagttcctttgctaacaagacatattcaaaccattgtagcgctcctcctgaatgtaaatgtcccttggcgaaaaggcagtttgaataaccagcattatgagtacatgctaacgtactcaattggtgggttcggtgttctactggatacgctttttaagaagagtgctcccttatctccagatcaaattagcaaagctttaagcatggcattgaaagagattgctatccaagttgatatgaaataatataaaaaataccatacgttcaggatttctaactgacatttagcctctataactatatggtagattgcatgagtacaaaaggttggtagcaattaaaaaatgttcgataaataaggcggagtagcccgttaaggactactttttttggctataataatcatatactgcaaacaggaggtggcttgtattgactaaaagggagttatcagtcccagaaatcacgacagaactaggggctcactgacaacgtgtgtatcgctcgataaaaggttgaggaatgtcaattactacggcgagcctactatcaagctggatagagagcattttattgtggtaggcatgtcgcggagatacaggtgccaaaaacgcgagtgagatagaaaaaaggtgtaaatgcttgatataaagccaaagcaagtcgatacaaagaagcgcatgtcagtacaaatgatacaggagaaaactgacaaagccttacagataaagagtttaagcaaggtagtgttgcagcacaaaaagtactggcggccaagggtcaacaaataaactagcacaacggggacttgaattttaattttttagggatacaataaaattatattgataagaggtgaatttaaatgaacaaatatgtcgaacttgatttagaacaattgcaacaaatctcaggcggtatgagtaaaaagcaatggtatcgtttaggagaacgtgtcggtcgtgtagcagtttttatcggtggaggattactttttaaataaaaatttttgcgtttctatactggtatgtgttatcgagaggtcggattctttatgaaaaaattaaaatcatttgaggtgctttctgatgaggaggctaaattgataattggcggcggacattgctatacggcggggtgtattcggcgtagagataagcctcggaattcagatagcttttttccgggattagcacatggtatttgtcaaggagttggtatttgcggatgaaaccccttttttataaaaaaccatcgttttatgtgtttattttattttcactgttcttaggtatttcattggtatatcggagagattggtggattacaatccctcttgtactagtagttttaatacaaggatatagaacaattagataatcataaatataagttgctcttggtttcataggaatcccaaaagtatagtaaaaatggtacggtccgttactgaaattagtgattgtaatatttttaccatgctttttatatttatttaatgtatgtctgcaagttactttgatacggtgtagacgtgattctgtgaatggacgctaaaaatatgaccaattttttattgtaatctcttattgataatgaaagtgtcgatgtccagaaaactatagcagtacaagggaaggtttattatgaatcttagcaagaataataaggtgtggtatcttatttcgtgtttatttctgggacttctatttttagaaatccccacacagtcagtaaatgctagtacaagtaaaaaaccagaagaatccgatacagtaataacggtagttcagtataaaaaaaatatattaaaatcgaataaagtaggtgtttcgggtttatataaacttataacgaaaaagggtaatcatccattctacttattttttggctctgaggagtgtcaatattgtcgaaagttttcggtaacgttgaagaaatttatggcacaaaagagcactcaacctgtctattatgtagatgtaaataaatttggtgtgaacgctgattcgcatagtgttacttcgaaaaaagtcatttcatttattaatgatagagttaatctacattcaataccgacaattgttgccgttaataatacacacatcataaaaatatatcatgattcaaatactacacttaaacagttgacagaactaaacaagcgactaatttcaaaataggttgtaaaaatgaaaaagtgctctaagagtaaattaaagttgcttgtactgagttctaaaagatgaaaattagctttcgaaaatggagttacggtcagccccatttccaagaaagctttttttgaatcaattatcagcaaaatttaatttcattatttgcacgttggcaggaggtggggacaatgtaaatacatacgaatttttgtgccaaatttaatgtataatcgcctcggaatattcatacggaaggtaacggtagaaactaaaacctgaacattaatcttcttcaactacttcagagagatacgttctgttaatctaacttatctatatgttgagattttaaaaaagaaagttttttggtaacaatgttgaaggggtgatcaatggttattggctatacacaggtttctaagaatggtcaaaaattaaatcaccaaattgaccaactgttaacttatggcgacaacgacccgaattcgaccagttattaccactaattcgagcaaacgacgtcgtggttgtcgaaagtatttctcgtctcggacgcaacacgctcgatattttaaatcttatccaactgctccatcaaagacaggtcaagtttgtctccttaaaagaaaatatgggcacggcaaccgttacccgccgggcaatactacaaatgatgagtgtaaatgcggaattggaatgtaatttactggctatcgctttaaggaagggattgccgtagttggccacgggtgccacaagagaaaatgaagatcgctattcgaatgtaccggagtaatgagtattcggtgaaaaagattctggcagccaatcagatctcgactgggactttttattgtgaagtgaatcgcttgaagctcaaaaattttaagtaaaaagatgaacagtaagcgtaagtgatcttatgattattcgtcttcctaccgcgaccttttcgtatagatgttccattgacctcattaagggaaagcttatgataaaagttaacatcctatcacggactagttgcaactggtctttattgctgatatttatttttttatttacccggcgaatagatagattttaaaatacatcatcgttgaaattacaacggttatttataattggtagggggagtacaagtatgcattggagaaactatgttgcgcaagttgacgagatggactgtggggtcgcagctttagcaatgattttgaaaaattatggttcgacaacatcattggcctatctaagaaatattgctaaaacgagtttagaagggactacggcattaggattagtaaaaacggccgaaaagttaggttttgaaaccaaagcaattcaagcagatatgagtcttttcgaggtacaagatttaccattgccattcattgtgcatgttaccaaaaatggggatctacagcatttttatgttgttgtaaaaacctcgaaaacgcatgtcgtgattgctgatccggacccaacagttgcggttatcagtatgtcaaaggaacggtttgaaagcgaatggtccggagttgcccttttctttgcaccgaagtcggaatataagccagttaagcaagataagggctcactatggggatttattccaagcttattaaagcagcgccgactggttattaatattgtgcttgctgcagttttaatcacgattattagtatctgtgggtcttatttcttacaagcggtgattgatacttatattcccaataatatgcacagtacattggcagtggtggccattggtctaatcgttttttatacctttcaggctatctttacttatgcccagaattttttattggcggttttaggtcaacgactttcgattgaaattattttaggctatattcggcacgtctttgaattgccaatgagtttttttgccactcggcggacgggggaaattgtttcaaggtttacggatgccagtaagattattgatgcgttagctagcacaattgtttcgctgtttttagatgtcagcatcgttattattatgggggcaatcttggtaatccagaatatgacacttttttggattacgttactctcgttgccaatctacgcggttgtcatcttagcctttaataaatcctttgaacgattgaatcaaaaggaaatggaaagcaatgctattttgagttcagccattattgaggatcttcatgggattgaaactgttaaggcgctgaatggtgagacggaacgttatcagaaaattgattcagaatttgttgattatctacgtaagagtttagcctatcttaaagcggatactttgcaacaggcattaaaactgtttatacagttagtcttagaagttgttgttctatgggtgggcgccaatctcgtcattcataatcagttatcagttggggagctcatgacatataatgctttattagcctattttgttaatccactacagaatattattaatttgcagactaagcttcaaagcgctaaggtcgctaacaaccggttaaatgaagtgtatttggtcgctagtgaatttgaggcgtcacggccaattcataatgaaagtcaattaaatggtgatattaagttacaaggggtcagctatcgttatggttacggtgaaaatgtcttagatgatgttaatttgacgattcgacaacatgataaggttgcaattgtggggatgagtggctctggcaagtccacgttagttaaattgcttattaatttttatcaaccaaatagtggtgatgtcatattgaatggcttcaacgttaagaacatcgataagcatacattgcggacccatattaactacatcccgcaggaaccatacatcttttcagcgaccattgaagaaaatttaagattaggtaatcgcagcggtattactgagaaagatattgcgaaggcttgccaattggcgttaattgatacggatattaataaaatggccatgcaataccaaactaagctagatgagaatggtaatacactatcaggtggtcagcgacaacgattaacgattgcgagagcgttattatcacccgctcaagtcttgatatttgatgagtcgacgagtggactggatgcaattactgaaaaacaattaattgataatttagtggcaatgactgacaagacgattatttttattgcccaccggttgtcgattgcaaagcggacgaatcatatcatcgttctgcatgatggtcgggtcgctgaagaggggacccatgcggcattgttgaatgaacatggttactattacgacttgatcaatagctgaggggggaactgaataatgagaaaagacctgctcgaaagtggcgagttttacgggattcggtttcaaaatttttcaacattactaattattccagtgacgctattgttaattggtacgattctgttttcactcgtagctaagcgcgagattgttattaatggtaccggaactgttcaaccgaccggaacggttccggtgattcaagcgactgttaatagtgccatcaaaaagaattatttagttgaaggtgcgcgagtgaagaagggccaaaatctattagtttatactaacgtttttaatcgcaataaattacgcgaagataatgtcagcaaacggcaattgcaacgccaagtgacagccttggatcattttaaagatggcatcaatactgacagtgatgtttttccaacgaccgatgaatttgggtaccgagaactattgcaaagttatttaaaacagcgtcaaatctatttaacggagaatcaaatgttggcagcgaaatcgagcgctgctagtactaagaaagccacgctaacgaagaccgcgcaacaagtggtatcaaatactaagaccaatctggatgcttatcaagccttatacaatgcggtggctaatggtagcaagtatgccaatagtgccaagtatgggtctgtttttaatgagtatgtcgctaagtcaaaggaggccaacaacgcaaacgataaaaaagaagttaaatctgcaacgttagcagacattcaacagcagatagatacgcttcaggattcgttgtcctcagctaaagtgcagttagaagaattacaagactttgatgatacgaagtacagtgttgagactaacaataccaaattagccatgttaaagaatgatcagttaagcgaagtcgctgagaaacgaatgaaagccgagcaagatttacggaccgtgaaagcagatattgatagcttaacgacacaatcaaaatcttacacgatcaaggcaaccaaagccggcgtcctacacgttgcagacaattaccgtggtgcaaagtacgttagttcaggagctgaaatcgctaaaattttaccgataatcaagcaacaacggcgagtgaacgttaagctatatatttcgacggcggatatttcttccgttaaagtcaagcaaaccattagattcaaagtcacgcggaacgtaccgaagccaattattttggacggtgtggtcacaaagattggggtctcaccagtcgaggagagtaaagcgactttttatgaagtgacagcggccgttccgattacagccgatcaggcacagttactacgctacgggatgattgggcaaacggcgattattacgggcaaggtgacttggtttgattattataaagataaggtgctggataataattgatacctgttgtgacagataattgcagaatgtaatcaatccatgtaatggggccaatggaacacctatacgaattttagcggtaggagaacgaacaagttaagatcaattactgaagtgaaagcgtctctaaatacttcgttaatcaaaaatactttacgtgattatcttaaaaaggttgggtggttaagcaatcttgtttgactagtcattttcagtatattaaattttgtgacttttatcagagaagttgatggtgctgaaaccagtcgaatgccagccactaaattagctacttttattgtgctagtggtttcctttatttttatcgtcttgatccaacttgtcttactgccatttattaagcatagaaagtaaaatcgagtttcggggtccattttacaaacaacccctcaaagaacattgttaaaataaccttcaatatctatagtgtagatgttggggggttattttaatgttattaatttgaattacccatataatcagtcctttttgtgcttcaaataaatcgttacaaagttaatccaagcaactagggtaccgactaaaaataagaataacactgaagatctcagactaatctcagattcattaacattattagttacgttaacccaggcactaaatcagccttatcaaggcttgaaccaacaagttcagcgagcaactagtccacaacaaaaagtgcagtttaagaaccagttaaatgatgtacaacaggaaatcagcaatcgaactcaaaaacaactgcaagcatttgctgaacagaatccggagatcaaacaacccgaatccgaacttgatcaaagtctaaaacgttggccagtttttaaaggtcatgctataatgtaatagaaaagggaagccttgcgctaacaagacttcccatgcaagccgcttcaaaggcggtggcagaaatttaataaacgattttagctcgtcctgtgacctctaccaaagttacacagggcggctttttttatttgtggtgcttgtcgatatagctgaggagcgcgattaaaaacgtgccaaacagcaacatcaacgagagtgtctggaagacgctcattgactgtgaaaccttcctgaagattattccatgttcccatgggcctcacctcgcaagggaaaagacagccaccgcccttaaaacttcctgcgtaatctattatacaagtgaattaagtattgaccaagcacaacaaaaattaagtcatggagtttcataggatcctaaatttgatcaaattaagaatcagcaaaacatcttttgtagatacccttttttaagttcttggagtttttcaagcttacgctgatgaagagtgatagtgtcgtctaattgtttgaagaaagagccgattttgtcttgttcctctatgcttggatacagttcagtccaattttcaacttctttttttgataagttcgtttggcctgctccatcgtcaaaacgcaaaaaatagtgatgtcgattcatcaacgaatgaagaaaatacgaattggtgtctgagtgtggagtaattccagcaatacgttgatttaagctgtatttgttatcttcatcaatcaaaaaggttctcgcaatagcacgaccatttggaacgtcactcaacacaaaagccagttcacctttttttaaaggtgctattaattcatcagaaaatttctttactgctccatttgtcgaaacaaattttgagtttactacaatgtaatctccattttctgaaatatctttttcatgagcttttccgtttctataatcagcaacttcgattagcttacgctgttcccaagcgtcagcaaaccctgcaaatcttaattgcgggaacttgctaccattttttgggaacattttttgcaaatagccctgtttaagttccttaagcttagttaacttacgctggtgaagggcaatagtcttatcgagttgttggaagaatgtgccgatttgtttttgttcttcgtaactgggaaacgatattatgacggaattaatcgtagattttgataaactaggtaccccagttgactcatcatattttttccaattaatcttttgaaatattgaatggtagattgtaaataaagatcggtccgttaaaacccttggggttgagcaggccggtcttttattgaattgaagcaaatttaaacattaagattatttttggctcgtgacaataatacattttgtatacccaagtaattaatcgagcgctgcaagtatcaaagtgtctccccgttaaagggcttagatatattagatgcaacttttttgacgtcttgaatatataatgagtaaagtgcttagatagaacaagccaggtcacaacttaacagttgtggcctattttttgatgctgtataattaaagggttagggtcgtgtcattacttaatgacataagtaaggagataaaaagatgaaatatggctatgcgcgggtcagtaccactgatcaaaaattagcaaatcaaattgagttactaaaattggcaggagcagaaaaaatctttcaagaaaagtttaccggcacaactactgaacgaccggagtttcaaaaactgttgcgcgttctaaaaacaggcgatactttgattgtcactaagttggatcggtttgcacggaatacgcgcgaggcattagccattatccaagagttgtttaaagaaaatgtcaaagtcaacattttgaatatgggcttaattgataatacgccgactggccaattagtctttacaatatttagtgcttttgcgcagtttgaacgcgatatgattgtcacgcgcacgcaagaaggtaaattgtatgccaagcaacatgatccgttgtttcgggaagggcgaccgaaaacgtattctgatgaacagatcagatttgcttatgagttgcgaaaacaaggcatgacctataaaatgattgaacgaaaaacggggattagtaaacgcacgcaacagcgacgatttaaattagttaaaaacaatatattttaaaactgtttacaccataccaaaaggggcttcgaatacgaggccccttttagatttagctagtaatccgtattaaagttaatgactagctcccagttcaactttttaatggcttacgatctgtcaacaaagcaattggtgacagaatcaagacaatcaccgctcctactaagtaggtatgactgaaggcctggctgatttgtcgattcttagtatgcttaatttttctcaaagctgttgttaaagcttctttttgtgccaattgtttgagacctactaacaattttttctgaccctggcttatttgctgattacccaaattaattttttgagaagctactgacagtttagatatagcggtattttgattctctaatttggttaaggtaagtgctagttgctggttacccgcttttaagttgtcagtagctagtgctaacttcttctgggcttggtagacctggtgaagatcggttcccttttggggccgtggtaaatcaacttgagatttggccgcttgtttaagggcacgtcttaggttcgtctgtttgtttttagtcgttaatttggctgatccagtagtggaaaataggctgttcaattgttgatgagccactttctttactttgggtgataattgctgtcgattaacaatttgaatggcatcttgatgaatatgctgcttagctgtattgacattattatcaaggaccgttactagaattgcaattcctaagcaggtgccaatttggcgcgctgcgttaacaattcccgagccaatcccacttttattttttggcaagtgcttaaccgaggccactaacgaaaccgaagagaacccaaaaccaacaccgttaatcaccagaaaattaatgacaacagctttaggcgttgtggtggtgataaacgacaagagtagtaaactagctgccatgactaagagcccaatcaaagtaaccggaactgcgccaacttgatcaaataacttagttcccaaaggcatcgttaccatgattgttaaggaaactggaataataattagggctgcatgtaatgctgtatcgttcaaaacgtcttgtaaaaagtaatttaaaatcagggtggggctaactaatgcaaagccggttaaaaagtaaactaaactagaagcagttagggttttttcacggaacaaatctaattcaagtagtgggtgtttgactttactttcgataaagatgaataatccaatagctaatacgccgccaatgagtgttcctaagatgatacccgattgccaaccatattggcggccttctagtaggccaaaggttaaactgcccaagcctaatgttaaaagaatcgttcctggtaaatcaattctccctgccaaggattcgtcatatgattcccttacccccatagcaacaattagaaaggctacaatggttagggggacattaatgccgaatacccagcgccaagaagcatattcaataatcacaccaccaatcggtggccctccggcagcagctaaagccgttaccgcgcccacaacgctagcaattttggacatatgtgttttgccaaatatttcaattcccattggtaagacaatcggggtgatgatggcaccgcctaatccttgaaaaaatcgaaaagcaatcaattctggcaacgacgttgccaacatacaagccgccgaaaaaccgccaaataaggctaatcctagtaacataatttttttacgaccataacgatcggcaatctttgaaccagtgatcataaacacggctaaggctaacgtatagatggtggcaacccaacttgtatcagttagactggcattgaaatgggtcataattttgggtaaagcaatgttgacgatagtactgtctaaggtgcccataaacatcgcaatggttaacccgataaaactgataattttagtagcttttgacatctatcaagcgctcctttcggtaacaaatggatataaaggaaacatttgttacctttatttgcgacttttagtataattagtcctaagcattaaaacaatccttattggctaagtgctacagattgctataatttgttaccgatagtagaggagatgttaataaaatgaacggcaagcagcgtatggttgagcagtctaagcaatggttatgtgacgcccttataaatttaatgacgaaagagaactttcaggatatttctattactgaaattgcccaaaccgctgaattatcgcgaaaaacgttctatcattcttttaaaaataaagaagcggtcattaattacctgtgtgatcagttgttcgatcagtactttgaacaattactccagcagaaaccgcaggtaggggaaatgatgttaaaaactacttttgacatttttttaaatttttggtggcgaaaacgggatttaattcaattattgatccgccaaggcttatttgatcacatgaatgaaatttggcagcaaaaagcaatcccccgttatcaacagtttgcggctccctggcatgttcagggcactcctacccaagtgaattatgtgatggcttttcaactaggtggttttaccaatattctacgcgtctggttaggccaagatcagcctgagccaccagaacaaattaaggatttaatgttgttggctgcccaacaattagctgatagtttgaataacaactaagcagatttaggacacacaacctctaattaagcttgtttctatcaccactcatcgctttatccttttgaatatcaaccattactacctaacaattggccatttgcttatttaaatcatttcggtgagaccacaaccgaccagaagctactagaaagacggacattagcaaacatacacaataaagaaaaaaacatgctgtgctatattcagtcattgcatatcatatcatgctatgatatgctttaactgtaaacaaggaggcgccctatgaaaataattactttttctgctattaagggaggggttggcaaaacaaccttaactttcaattatagtgaatggctgtctagcaaaggctataacgttttgctgattgatagcgaccaccaatgcagtctgacccaaacctatgatatttataaagaccatggcaccttagctaacatttttacaaaagatagtgaaaaagtagaaattattgaattgcacaaaaacttatcaattattcctgcttctatgaatttagatatggtcaacaatgatcttcaaacgagagccaacaaagaattactaatgtacatgtggttctcagacaattatgacaaactgaaaaaatttgactatgtattaatagacacacatccggatttttcgacaatcacgcaaaatatgattgtaatttcagatttagtatttagtccgattgaaccaagtgaatacggttttatttccaaaagtaatttggaattaagaatggaacaattaaaacaagaagtaattaatgttgaaagtcgtaaaagctttatcacagcagaactaaaatttattggaaatagaataaaacataatactaaatcttcacatgaatttgtggaacaaatgaaaaaagatcccagaaccattgccttaattcctgaaagagaagtattcaataaaacaactcttaatcatgaaccgctgatcaacatggaaaaaggcaaaagctcaactccaaaagcaagggaattttttgagaaaattgacaaaatatttgatacgtttactaagcaataatcatatcatgctatgacatagtgtgatatgctatcgaaaggatcaacatcatggcatttgaagataaaatggaccaattaaaaaacagtatgaacagcaatccaataacaaatgaacctcctacacctagagtttcaaagtcttatactttaaaacaaaacgttgctaatgaattggccagacgtgccaaaggaaaagagttaacagcttccagatatttagaacagctattgaaaaaagagttcaatctataattatgatcagccagaaaatgcataagtacaacagcaactacaataaatgttacattttttggttaatttaattaaaacatcgattgaataatatttgctagtatattcaatcgcttgttggttccaaactaagagctggtaaagtatacaagatcaaataatgttgctggaagataagcgctatgctagactaaaactaatttaacaaccgaatagaagataaagctaaacagaaaaagtccctgattcacggggaatcagggactttttgtttagcaagtagctatcagacagctacttagattcagtcgattttaacttggcggtgaaaatcgactgaacattgttcttaatttgtaggttaattataccgcaaaccagtcctagaggacaagtgaaggatagttaaaaacaaatcaaagccaatggactaagtagctaaccgaagctatttagtccattttttgttgttagaaattaaaaaagttgccgaatgggcaaccaagaataggtacacgctggtaaattacaaagccctcacggctaaatgaatgctttgtaatttagttaaagcatatcagatttgtattttaaagcaaatctaatgttttagcaactctctttcgagacagtgtgtgtcagttgagaagggaagttttataatgaatcaaactaatttcaattttattgagtcggaaaaagcttatgcaactcgttttttccaattcccacaggttttaatttatggatctcaatataagacattaagtgatagtgcaaaattaggatatatgattttacacgatagactagattattcattgaaaaacaactgggttgatgaagataacagggtttatttcatttttacaaatcaagaactaacagatcttatgggctggtcaaaaaagaaagtgattagggtaaaaaatgaacttgaaaaccaaggattattatttcagaaagccatgcactttaatcccaaaactggtaaaaatgaaccaaatagattgtatttagcagatttagaagttaccgcaacagacatttatacaaaatctcggcaacaagagccacgaacccttggtacacgcgaaagtgtcaaaacggaaccttcgcggaagttcgttaaaacccttgatacacgcgaaagtgtcaaaacggaaccttcgcggaagttcgttaaagatacaccacaaacccttgatacacgcgaaagtgtcaaaaagagtcacaatctagactatactaataatttagatactaatagatataatatagatactcaaaagttggacttttccacagcccaattctcaccagcagaactagaaaagcaaaacaaggatttggtgaaccatgctaatgatttcttaactgataaagatagtggcttaccggttttcttagaacccgaagccgtacaattacttagtttctggtgccgaactccgcaacaaatgcgccggtttattggtatcattctgaatgctaaatatcgagttgaaaaggatcatcaggacattggcgtcataattccacttgatgatgaggaactgaagcctttaatgactaaagccttgaggcgctactttaacgccctgagaagcaatgagaagcatatcaagaacgttgaaaactacttgtacggcaccatgcaaaacctatttggggtttggtggaataaagaagcggctagagaatatgcggctaaacaccccgaggaacagaacgctggcaatgaacgcacttggagttaaacaccatataagcttgtttaagacgttttaagcgaacgggaacattcttatattagattatatttaaaatgggtctaaagccgttttaggagcccaatattagtgtctattagctatccataggaaagatggtgcgaccacatggaaattaaatacgataactgctcagtacagctttagtaggagtctgttctgtactaagcatattttcaacagacaaagctgtacttttgtttcgacttactcgttattgaaaggcagttaaaatgaacaaagaaaaattaaatttatggcatcaggaagaacaatatggcattacaggttgggatttttcacatcttgatggtcgttggcaaaatgaacttcctccctggaattatcggaaactggtattaagctatttaaaatcagatatgcagctattggatatgggaaccggcggtggtgagctgttaaaaacttttcatcaccctagtaatagaacataagttacggaggcttggcagcctaacattaatcttctaaaacacacgattgccaaacaagggatcaaggttcatgctttgtctgcaaagtatgaagatgccttacctgttaaaaatggttctctgaatatgatcactaatagtcatgctgccttcaacccaaaattaatcaaagataagttaaaaactggcggttattttatcagtcaacaggttggggctttgaacaattattcattgtcacgctttttcgattcagattatgttccggcatatccagataataccttgttgaaaacagtcgcagattttcagaatttgggttttgaaattttgttagctaaagaagttcaacccagtatgactttttttgatattggggccattatttattacgcttcaattattccttgggagtttcccgatttcagtgttgatcactgcttatcacagcttactcaactagatcaattaattcaaaatgacggttcagttactactaaagaggatcgcttcattttagttacccgaaaaatgtaatctattttgattgaatttgagatgctttatcaaactaaaaatgaaccgaaaaaatgattcagaaaataaaaacgatcggcctagttattaggttgatcgtttttgagtttattcggcttatgggcattaacataactggcaaatgtttttaaaagctcttcggtttgttcaaccgagagattatcagcttgaaagtatttttctagcaaagcccctttttgaattaatcggcgagaacgggctttgcgggcttgccgattttcgtagtatttagattgccgtaatttaaaatcttcccgctcaattttttgttttaaacgcgcttgctgctcaactaatttttcatattgattaggcatagtcattaccacctaactattattggttattttgagattgatttaaaaaggcggcaacttttttagcaatcattttaatttgtggagtggtaagtgttccataatccaaattggctgatctaatgatttgtttaccgaggttttgttcaatcttgtttttttcagctttaatcttttgattaagctgttttaatttagcttcttgtttttctaagttactttgagtcacaattatccctccaatcatcttaaaaataatcacggacactatatcataaggtaaacgttaagtcaaggtataaaagttgaaatagcaaagcgaaagtcatacactaaattgaagttaaggtaatcagcagaccgagtgaaacgaggtcaatgcgcacttacacacaacaactaaagttggttgtgttattgtgatagacccttgtatcagaagtcgccgttggcgacaacaaaagcaaacccataaacccaaagaaaggtggtgaccgacatggcaatttttcacatgagttttcaaaatattagtgctggtaaaggacgtagtgccattgctggagctgcttatcgaagtggtgaaaagttattcgatcaaaaagaaggccgaagctatttttatgctcggtcagtcacgccagaaagctttattttgacaccaaagaatgcgccagtatgggcgagtgatagagagaaattatggaatgaagtcgaaagaaaagatcggcgagcaaattcacgctatgcaaaagagtttaacgtggctttaccagttgaattaagtgaagatgaacagaaagaattattgacaaaatatgtacaagaaaattttgttgatgagggtatggttgccgacgtagcaattcatagagatcacccagataatccgcacgctcatgttatgctaactaatcgtccatttaatccagacggaacatggggattgaaaagtaaaagggaaaatatattagatgaaaatgggaacaagacttatacaggaaatagtcgttttccaagatcaagaaaggtgtggctagttgattgggataaaaaagaaaaaattactgaatggcggcacaattgggcggctagtgtcaatcaagttttagagcaaaaaaatattccggatcggatcagtgaaaaatcatttatcgagcagggaatagatgatacaccaactcaacatgagggaatcaatagcaagcggcatgaaagaaaagaatttaaccaacaagtaaagaactatcgcaaggccaaatccagttataaaaacaaccaagaaaaagtaatcaatagaggtcatttagatagtctaagcaaacatttctcgtttaatgaaaaacgggtggtcaatgagttaagtcatgaactgaaaacttatatcagtttagagagcttagatgataaacggcgcatgctatttaattggaaaaatagcaccttaattaaacatgcagttggtgaagatgtgactaaagaattattgacaattaaccaacaagaaagctcattaaaaaaggcagatgaactcttaaacaaagtggtcgatcgtaccacgaaaaaactttatccagagcttaattttgaacagaccacgcaagctgaaagacgagaattaattaaggaaaccgatagcgaacaaacagttttcaagggtagtgaattaaacgaacgtttaatgaacattcgtgatgatttgttgacccaacaattattgacctttaccaaacggccatacgttggctggaaattattaatgcaacaagaaaaggaagtcaaaatcgaactgaaatatacgctgatgattcatgacgataacttagaaagtctagaacacgtcgatcaagggttactagagaaatattcaccaaccgaacagcaaacgattacgagggcagtcaaagacctacggacaatcatggccgttaagcaagtcattcaaacgcaataccatgaagtattgaaaagagcctttcctaatggtgatttagatggtctttcactagttagacaagaacaggcttatacagccgtgatgtactatgatccaactttaaagccattaaaagtcgaaacaatggcacaatggcaagaaaacccaccgagggttttcagtacccaagaacatcaattagggttagcttatttgtcggggcagcttagcttagatcagttagaaaatcatcacttacaacgagttttaaagcatgacggaacgaaacaaatttttcttggtgagtgtaaagatgatccaactattaaaaccagccagattgaaaaaatccaaaagcagttaaaagagcaacaagccaaggacgaccagtacagaaaagcaaatatcggacattatcaaccactgaactacaagccagttagtccagactattacttaaagacggcctttagtaacgcaatcatgaccgccctatatgcccgtgatgaagattaccaacggcaaaaacaggcgcaaggtttaaaggagactgagtgggaaatgacgaaaaagcaacggcaacaccaaactcgaaaccggcatgaggatgggggcatgcacttgtaatctaactgtaaaattaaaagtgcactaacgtgctcatttaatggtataatgaatccataacataaggaaaggagtattcacatgtgacaaagaaacaggaatggtttagcttagctcaagctagtctcaagcttgaacgcggtagtacgtacgtgagtgtttggttaagacggcaccctaacgagttaccaagtgaaatgctcatggaaacgggcaaagttaaattaatatctgaagatggcattgaatggattaaaaaccacataaaaaaagagggcgtcctcgtaagcagtgaagttgctaacgaggatcagcacctagaagttacgattctgggtgtcaccctcctaacaatccattttaccgggcgggttaggggaaagctagttgtttagcgaccctaatgcgctttttttgaggaggtgatttaatgaaagtagaaagctggcaaggcattaatggcaagttactacatgataaccaaaaggcgattatggttgatgacgaccaagcactaactgaccagaagcagctacaagcgatattagatcaagacggtcagccaatcgatgaagttcggcaagcaatgattaagaagaccgttaaacgccagttgaagactgagccgttaaagcttagtggttggtttaatcgccatcaagatggtcaaaatgctaagaagaccgaaaaattggtaagtgataaacccacccatcaatataagcagatcaaaaatgaaatgaccttttttggtgagagtttcctggaaggcttcttaggtttctatgggttgaaagttgataacgccttaggccgttacgaacataatttgcatgtcttagagacccaagagctaggtcagtcagaaaaagagtattacttagccatgagcgaaaatggccacgttaaattagccaccgacccattaccaaaccagcaaattgccgaggagcaattggataagttctaccagcgggaacccgagcaaacgcgagcagaaccgactcaattacgttcacaggaagacggaaaggaggaataatatgaagttcagcaaagtaaaagcgctagcaaccactggagctactgcaatttacttgggcttgatgaacgcccaggtcgtctttgccgcagacggtggcgaagttaaaagtaagctaaccagcgctggtaagacgattcagggtattttaaccgggttggttgttttagttgggatttgtgtggcgctatttattattatcaaaagaatgcctgacgcagacgacccacgagagaaatcagaggtttatcacgcggttggtcgggtggctggtttagtggccctagcggcagcgattatctggctattaccttgggtttacagtctatttacctaatttaaaaaggagcctgccaaatgaagaaaggaaaagaatttatcttcccagagaacgtagataaagattacgggatctggaaagactacaccttgaaggattttggctatgcggcgctggcaggactagtgggcttaatttttattgcgatcccaccctatggtctgatcttagtcctgataaaaatagtgattgttgtcttagccatgaccgtggtcatggctattttaacaattaggccagtttcagcacgcaagaatattaaagtgcgggataactttaagttgaagcgccgctatgccaatggtcagaaactgttttatttaaaaccgaagaagcgaggtgaactaaatgcgtttgacgaagaacaaaaccgccaataaatcagccaggctagattgggattaccaaccgcccaaaatcaatggtggcaaagaaaccattgatgacatgagcttggtggtgggtatgtatggtaattacgaagttaccaaaacgggtaatctcgttggcattttggaagttagtgggatcaacctggatctacttaatgaaaccgaacagcaagacgtctttgaggactatggtgcgtttctgatgagcaccttaggtgaaggtgttgatgacaccttacagttcttagagccgacgattcccgtcaatatgacggcttatctaaacggtctcaaacggcggtatctcactttacaaaaagatcaccccgagcaacagttcaaaatccaattaatggccagttacttggatcactttactaaagtccaagaatccaaaaacatgacgactaagcaacacctgctaatcgttaaggtgccgattaaggacaaaagcgttaagagcttaaacctagcggtcactcatttagacgaaaagatcgaacaggttaaacgagacattgaaaatgcgttaacagactttgatgtgacggccaaagtgttgactagtcaagaagtccaagagattttaaagaacttaatcaatttcaatggataggaggcaacagtatgagttttggtgataaggtcattgatttgttcatgccaaccaagaaagaaagtcagcaaaatagtgaaccagcggttaataaacaaaaaccggaggttgaagactttaccaagctgattgatcgcgatagcttgcattcactattcccgtttagctgggaacagtaccccacctacgtccagtcgggggagaattttattcgggtgttagcgattgccgactatcctaagcgggtgtatggcaactggttatcggagttaaagcgcaaaaaaggcgttatcgatattgtgcaatatatcgacagcgccagtaacaattcaatgattacctattacaagaagacgattcaaaataaggaagcgcagaagctcaatacgttcgacccgtataaaaagaagattctgcaaaattatattgattcagccaacatgcaactagataaataccttgataattctaccacatttgtctaccaacatatgctggtttatctgcgggccaacagtttagcagaactagacgacttaaccgaaaacgttaagaatacgttgattaagctacagatgaaaccgctagtaccggttaaagcaacctttcaagcattttggtcaaccatgccaattaacgagaacctcatgggggattacacgtacaaagaaagtaataccgaagttgccagcagtatgtttccctttgatgacgccgaaattttggacttaaagccgagaagtgatattgagggtgtcaacaaagataccaacagcttaattgccgtagatatgctggatcgcaacaagaccctaaatcaaaatcaagtgattatcgggacctcgggggtcggcaagaccacctatatgattcagaaaatcctacgctacgccattcaagactatcaactctacattattgatccagaaaatgaatataccaaaattgtcgaagccctaggtggggcagtcctgcacctaacttctaatgctaagtacaaaattaacccgctacaaattttctccgaagaaatcctaagcgccgatgaagcggtcacaaaccttgatttactagttaaagataaaatccagcgattaaaggggttctttgaagtccttaaaaccgggattacccaagttgaactggcaatccttgatgatgtcgttaaacaagcttacgtcaacagtggtgttttgaaatacagccgcttaaaagagattaaagacgatcagtggccgaccttatccaatgtttatgacgagttggagaaactggctgataaggacgcagacaagttcagtcgggttaaagacttctactacatcttaggcagctatacccatggttctaacagcctatttgacgggcacaccaacgttaacctaaaggggaaaatcatttcttttgatttaaaaccgctacaaagtgaacaggaagtccaatcagcggcttatctgaataccttccagtatttgtgggacgaaatcaccaaagatcggcatagccgcaagaaattgtttgtcgatgaatttcactttttgactttgcacaaagcggccgccacctttttccatcaagcttataagcggttcagaaagtataatgctggggcgattgccggaacgcagcaaattcaagatgtgattgaaggcacaacggatactgggcagaatattggtgaagccattattgggaattcctacaccaaagtctttttcggtcttgacggtaaaggtgtcgatgatgtcattacgaaactgcgcatgaccttttcagataaggaaaagaagttactagaacgtcgtagacaaggcgaagccctgatgatctatggtagccaacgcgcctttatgcgtgtcgagttgaccgaagaagaactacggctaattgacccagaagcttaccaagaaaaatacaaccgtgagacagccgtgcaaccggactatcaaaagcgcgtggtcttaacacctagtgagattgacgctttaactaccaccgaagaggaaggggggactttaaatgagtaaatcaaaccaactattaaatatcgaggttgggacattcaaacggcaaggaaacaagttgatcctagagcttaatcacaatcaatttcgatatgaccagttgagtgagctaaacgaattaaaggaagctgatgccaatttcttacagttggttaacgtagttgagcaagaccagaaggttgttttaacttataccttgccggataaggtcagatcattaaaggaattaccacatgaaaataaagcaatccggtcagcaattgccaaggaaatcatggcgcaacatgtggttaacgatagccagtatcacattgcgttgaacccggctaacctgtggtattaccccatgcaacatgtttggtacgcctatcgcgccaatgaactcatgccttatgatgacaaacatagcaatttagccaaatacaaagcgctgattctattttgcttgacggggacgccctatgaacggctactaagcaatcctcaagaagccctggccaaacacccggacgactatttacaacaagtagctaaagctacgtcgttaaatgagttaagggaagtggttaacggcattgaggattttgtgagctatcacgaatggcaggcagttgaaacggcccaacagaaaaccaaacaacgtttatggttgagcgtggccggagtggcgattgtggccgttttggctgtcggtttagtccataaaagtgacgaacggcaatatcaaagcttagctaaccagaaccaagcccaggtcacacgattaaaatatagcggtcaaattcaaaccgctttaaatgatcagaagtggtcggaagcgcaaaaagatatgaaacgggccggctatcctgtaactaagcaagtcagtgtctttttaaagcatcgtcagtaccagcaagccttaaacgttgacccaagtcagttgaacaaggttgttaatgcggcttatgccaaccaagatagcagtcaagtggccgattggaagttaccaactaaggcgacgagtaagcaaaaagatcaattgaaactcgaaaaagcgattgttaattatgataccaatacgcttaataaccaattatcctttacgacgaacgctgatgttttattgagaatgggacaagccttcctcgcccataatgatacgcaagacgcccagaccgtccaaaccaaattagccggtgtgaatagtcctaaagctaagtatttaaaagccctgttaagtctcaatgccgctaagaacgaagttagcgacgcccaaaagaagttagatgacgccaacaagattgatggcagtaaagataaggataaagacaagaaggtggattcggctaagtcggacttaaagaacgcgcagagtgaccaatcagcagcgcaaaaacaagtcgatcaggccaagcacaaagtgggtgattaaatgcaagtactgtctttcgaatataagaaaaagaagtggaagttgattgcttatattgtgggcggcgcccttctgctaatcatcttgctaatcgccgcgcttactggtcaattgcaagaaaacagttgtgataactcaaccactacagaaacgcaattagatagtaagagcatgacagaaaatgctaaaaacatttatgcgcactggaaacagaagtatggtgccacgccacaagcggccgctggtatcttgggggtcttacaactagaaagtcgccttgatcccaagtccgttaattcaagttccggggccacgggcttagcccagtggttaggtggccgaaaagataagttggaggacttagcccacaaagaaaacaaatcagcaaccaatctcggggtgcagttggactatctcgatcaagaattgaacagtagttactatgcgtcaaacaagcagatctttaaatatacggacgtgcacaaagcaaccaaagcctggttaatggattatgaaggcatgagaaaaaacccggaacaatggtatttaagccaaagatacggttatgccgatcactggtattccgtgttgggggcgagtgatccagtggccggtaatacgttagacaatgcgagttccggcgatctgaccgagctaggttgtgatagtgacccgagctattccggcggtagtatcgtcaaaaacgcggaaagtatgaaaggtgacttctactatgttcaaactcaccccagccctgatttaggtagcgatttaaagaatcccagcaaaactggcggaactgattgttcgggctttgtctggttagccttgaataaggctggttacaaggtaccggccaacatgggctggtttaccggcacgatggccagtgacgccaaaggcagccatcaatatctgaaacagatcagtgaaaatgacgcgaaagccggcgatattgtcatcgtcaatcaaggtgcgggagccggaaacaacggccatactgccattctgctaggcaaatggcaaggcaaagccaccaaaatcattgaacaaggtggcgtagacgacaaggttaacgaaagcacctttggcaccgccttttatagcttactaagtggtagcgatgtaacgttagcccggtcaatcaagaagtaaggaggaaccaacaaatgaagcgtagcgtggttttaagtgtggtgattggcagcttgatcttagttatgtcattaggggcgaatgcctatcaacatagccaagttaagcaggcgcaacagcagatcagtcgcttacaacagcagaagcgtcaagtcagccggcaattgactaaaaccaaccaacaaaagcagttattgagcacccaaattgacagttataagacctaccaaaataataaggacaaaagtcaggctgaattgagctttaatacggtggtcaccaagttctttgacgtcatgaataacttcaagcccaagacctacggtcagcgtaaagatggcgttaaagacttgatttccgacaaattgtaccagcaatacttttcaaataaaggcacgtatggtgatagcaatagtgtttcagccaaattagatcagctgaacctgtatacacaaagtaagcaggggcaaaacatgaagggcttggccgtcgtcagttatgaaagtaagagtggcgacaacgactggcaaaaggcgacggtgctttatcaagtgactttcgataccaccacgaatcgaatcaccgcagtccaaaacttaggcagtagcttcaaagccagtgaccttaattaagcgggttggtaaagccctagcggtaatcgtggtggttttagccgttggcgggtttgccagtcatcaatatgtcaaccacgtagaaaagcagcgaccaatcgtgactttagctaagcaccctgaaaaagtgttgttcttctatcgtgatgattgcccggattgtcagtctattttccatcaaatttattggcacaacgcaatcagtcataacatcgtcttgattaacatgaatcaaccgcagaatcggcattacattcaaaaatatcaattaacgtcagtaccaaccttgatccatggtaagcaacggtacaccggcaccaaccaacaaagaattaaacagatagtaggtgattagatgaaagacaaattattaaacagcgttaaagctagttggccgtacctactaacgctaatcattggcttgtatttagcggagattttagctggctctgtcatggccttgtcccgctataagttggcatttgcagatcatatgccaaccgtattaaaacaattagccttacacccttggcactattacaacttgtatttgggccaaaagaacccagtactaattattgtcagtgtcgccgtggtcctatacaccatctattttgctttgaagcgcaatagcaagcacaaagcgtgggaaaccgcagacactgaaacccacgggagcgcgacttggggtaatctaaaagaattgagtgaccattactttagtatcaatgccaaagacctcaccacagcatttaacaagagtaccaaggccgaaattctcaaatcattagtggatcgagaaaagtcagcgaagggaggagattaacatgaatggcaccattttagggatcgtggataaacagattgtttaccagaataacagtaccaagccgaatcgaaatatcttcgtggttggtggcccgggatcatataagacccagtcagtcgtcattaccaacctgtttaacgaaacggagaacagcattgtcgtaaccgacccgaaaggggaattgtacgaaaagacagccggtatcaaactagcccaaggctatcaaatacatgtcgtcaactttgccaacatggcgcacagtgatcgctacaatccttttgattatattcaacgggatattcaagctgaaaccgtcgccacgaagatcgttcagagtgaaaatgccgaaggcaaaaaagacgtatggttcagtactcagcggcaacttttgaaggcactaatcctgtttgttatgaaccaccgcgcgcccgaccaaaggaacttggccggtgtaacccaagtcttacaagaaaacgatgttgaggccgaggaaaagggcgcagatagtccattagacaccctgtttcttgatctaaccatgactgatccagcgagacgcgcttatgagttagggttcaaaaaggccaaaggcgaaatgaaggccagtattattgaaagtctgttggcgaccatttcgaagtttgtcgacaaagaagtggccaattttaccagcttttcagactttgatttaaaagagattggcaacgacaaagtggtgctatatgtgattattccggtgatggacaatacctatgaaagcttcatcaatctgtttttctcacaattgtttgatgaattatacaaattagccgccgatcatcacgctaaattgccccaccaagtcgattttatccttgatgaatttgtcaatttagggaagtttcccaagtatgaggagttcttagcgacgtgtcggggatatggcattggtgtgacgaccatttgtcagaccttaacccaactacaagccttgtatggcaaggataaggccgagagtatcttaggtaaccatgccgttaaaatttgcttaaatgccgctaatgacgtgaccgctaaatactttagtgatctgttaggaaaatcaaccgtaaaagtggaaaccggtagtgagagtaccagtcatagcaaggaagaaagccacagcaagagcgatagttacagctatacgagccgttcgctcatgacccccgacgaaattatgcgtatgcccgaagatcagagcttattaatctttagcaatgcccgaccagtcaaagctacaaaagcgttccagtttaaactatttccgggggctgatcatttggttaacttgtcacagaacgattatcaaggccaaccagaagccaggcaggaaaccaactttaagaataaagtagaaaaatggaaagcaaaattaaaggagactgctcaaaaagaagtcgcaaacaagatgtctcagaaagaggaggagcaacaacaggacaacctagacagcgatttagagagagtttcaaataaagatagtcaaacagagacgccagaagaagacgacaacaacttatttggataatggagggcatattaatgaaaaaatatcgcaaatatataatcgccgtgatgacagtgttgctgattgctgttggtctaaccgcttgtgggaagtctacagcacaagatttgcaaagtaacaaatggtatctcaaccaaaaaggtcaaagctacaaaacccaattcaataaaaaaacaatgattattgaaagccctttgatgaatgtaaatgccacttattcagtcagcaatacttccggtaaagaatatttaaaagtaaatactgatgatgagaaaaatcaaaagtttgaattaactcaaattagcgatggttataaggctaaagcaattaataagtctgctaaagcagataacggattagggagttttgaattgcaaaaaaggaagtgatagagatgtttgttttaggtgacatttcaggattggttcagggagcgattgctaaattttttgaatgggcattatctggtttgctggacggtttattcaacatctgcaaggccattattgaccaagccaatcaaagtttgccaattgttaaaacgtggtatgccatcttcctgtcctttgcgacatcgttagtcgtcgtggttgtccttgggcgtattgtgatgacaattctaaaagaggcagatgaaagtaccgatgtgacttgggctaatatcatcatggatgggattaaatcagcggccgtgattccagtttttgtgttcttacaaggctttattcaaggttcaattaccttgcccctgctaaagtatatgtttagttctgatcagaaattcactgctaaatcaattagcggcatgaataaagtccctgggctaaaagatgttggcatttcgttgcccttacagattttgtttctgctaatcttcactgtcgtaaccgtcgtgttctttatcaagatgtgtgtgtttgtggctgatatggcttggtacaacctgacgattcctttagctgcaatgagcatggcgactgaaagctttgattatagtgccacgtggtggaagaagtacatttattacaatgcttctattattagccaggtgctttgtatgtcattatcagtatggtgcttcactaatatggctaaatacggatttattgcctttattgcttcaatcggattcggctttctggttgttaaaacacctgacgccgttaaagacttctgggcttcaaccggtgtgactaaaagtgctggtatgggcgccatgagaatgtttcaaaattattttcgtaaccgttgaaggaggttagcgtcatgaaaaaaatctggcactggttacttgaaaaagccaaaaaagatatgcgaaccgacccttttgcaacaccttcacggcggactaagttgtcttactattttgataacttagttagcatggtcttctatataatgggaatttacctcatgttaatggatttataccaagagcttttcacggcgaaccataccgattttttaggaactgcgctaatggccttagttttactgctgggtggcttattattccgttggtcagcctatgcagatctcaaagccatcaaccggtatcaacattatttaaagcaacaatcgatagagcaacaacaagaattgcgccgtgaaacttggttgaaagcggctaaacaaggcaaaacagaattagatcaaaaattgaatcataaggagtgaacgaacatgaccactgttatcttagctgaaaaacccagtcaagcccgttcatacgtagaagcatttcaacagcatacaaaaaaacagggttactatacggttagtgaccctgttttgccccaaaatactgtaatcacgtatggcttcggccatttggtcgaattagcaacaccagaaaaatacgatcaaaagtacaagcaatgggcgctatctaatttaccgattttccccgataaatacaagtttatcgtgccaaccgataagaaaacgcagtttaaagtcgtcaaagatttactaacgaaagcagatacagtgattgttgccacagatagcgaccgagaagggtcaaatatcgcgtggtcgatcatgaaccaagcgcatattgatgttaagtcgaaaacgattaagcgcctttggttgaatagcttggaaaaagacgcgattattaccggattcaaaaatcttggtgattggcacaaagactatttggcttacaaagaagcccaaacccggcaaattagtgattggttgatcggtatgaatggtagtcccttatatactttattgttgaggaaaaatggggtgcgtggggtgtactcaattggtcgcgtgcagacgccaaccttgtatatggtctatcaaagagaccaggcaatcaaaaactttaagccggaaccctattttgaactaaatgcggaaattttagccaatcagcaaaaattcgtcgcaaaattagacccctatcagcggtttaaagatgaaacagggctaatgacattcatgcaagctaaacacgttcagaaaggctcacagggcggtttaatcaaggacgtgcaaaagcagtctaaaaagagtgccagtccccaactattctcgctatccagtctgcaaagtgcgatgaataaacggtatcatgccagtgccagccaaaccttagcggccattcagagtttatacgaagctaaattccttagctatccccgaaccgattgtgcttatatcactgatgaagaatttgagtatttagtggctaatctgacgaagtatctgggtttagtctctacacaagtctctttaaccaataccacgccaaataagcgttatgttaatggaaaaaaggttgaagaacactacgccattatcatgactaaagttgtaccgacgaaagatcaattagctgccttacctaaattacagcaacaggtctatgatttggttttaagaacgacgttagcgatgtttgctgatccgtacgagtacgaggaaaccaccattattacccaagttggtgacgccaattttaaagcaaccggtaaggtcccaacgaagcaaggctggcaagctttatttgatgatcacaaagccgaccagcaagaagcagccaccttaccgctcgttcaccaaggcgatcaggttaaagcaaatctgcaaacgccgcaaaaagaaacaaccccacccgtgccatttaccgaaggtaccctgattacggcaatgaagaccgccggcaaaacgcttgatgatgaagaagcccaggcgattctcaaagatgtgcaaggcattgggacaagtgcgacccgggccaatgtgctggaagtgttaaaaaaacgcggctatttggttactgaaaagaacaagctccacgtcagtgaagcgggaattactttatgtaaagcggttgaactcgaacctttgttaactagcccagagatgacagcaaaatgggagcaagcgttacaacaaatcagtaccgaagaacgcaccccggataactttttgaaccaaatcaaaaagttcgtggaaaaattgattgctgatgttcccacgcaattgactggcagtgcagccattaagcaacaaatcgatcaccaacagcaagcgcaaaaagccgccgaagttttcttagaaacaccgcaagcgaccgttttaaataaacagaagttttacattgtgaagcccaagcaaggtgaagattttaccttacctaagaaatggagtagcaagacgcttggtaagacagcgattaaggcgctggtcaccaaaggggaaaccagcaaattaaagggtttcaagagcaaaaaggggaagtcgtttgacgccaagttaaagcttgacggccataaattaagttttgattttgattagaacctgcctaccgcccttcacgttgttccggttggtgaacccgtcatttaggtttacttt

SEQ ID NO: 7 - DNA, 35007 bp, Lactobacillus plantarum
tagcgtcaccactcacagtttgtgacccaatttcagcctggtctggcgtgtaacccttaatagctgggctagttactgccgcaaagctttgatctgctgaccaagacccataggtcttttcacctgtcaccgcatcagttgagacttcacgcgtaaattcaaccggcttggccacataatcatcatgagctgtcgtaccatctttgtagacgtaatggatagtttcattaatcgtcttgctttcagttgtaatagttggcgcattcttagcataaaccaccgtgaaatcaagatcactggagtcaccactcacagtttgtgacccaatttcagcttggtctggcgtgtaacccttaatagctgggctagttactgccgcaaagctttgatctgctgaccaagacccataggtcttttcacctgtcaccgcatcagttgagacttcacgcgtaaattcaaccggcttggccacataatcatcatgagctgtcgtaccatctttgtagacgtaatggatagtttcattaatcgtcttgctttcagttgtaatagttggcgcattcttagcataaaccaccgtgaaatcaagatcactggagtcaccactcacagtttgtgacccaatttcagcctggtctggcgtgtaacccttaatagctgggctagttactgccgcaaagctttgatctgctgaccaagacccataggtcttttcacctgtcaccgcatcagttgagacttcacgcgtaaattcaaccggcttggccacataatcatcatgagctgtcgtaccatctttgtagacgtaatggatagtttcattaatcgtcttgctttcagttgtaatagttggcgcattcttagcataaaccaccgtgaaatcaagatcactagaattagtgtagacagtttgaactgcaacgcttgtcaaatcagagtttggggcatcattactgattaccttatagccatcaacttctggattaactacttctgcgaaatcggtactgtctgcttttgtccatccagcttctgttggcacaccattatcatccagcgttgcagtctttgctttagttgagtaatacgttgttgttgtgttatcaactggattagttactgtcacaaatgtaattggatctgccgtatatcctattgctacttctttaccatcttggtcaatatacttaatggtttcactaattgttttgctggtttgtgtgtacgctggtgcatagacataaataaccgtcccattatctccagcttttgttagagtacccgtcgctggcaaactttttgctccagtggcagtaccatcatccattcttacaaacttataattgggaatttctaattgtcctgtagtataagtaccattaacattagcgccatttggataagtaacctcaccttgagcaatttgattaccttttgtatcaacatacttaacattaactgtcgctgcttgcttaaaatcaaaactcattatttcaaattgctgtaaattcttagcaccaccagttgatgcactgacaatcattgccattgcttgattagaattcgagacagtcgtagtccaagttaatatcttaccgcttgtttgggtatacttgattgttaatgttcttgtatctccatcataatcaactgtaaaatcatgaaattgaccgtttacgtcagacttacttaacgcttgggaagttccatcaacatctttagcccaccatctttgaacttttattccatccttagtagcaacttcttcattttcagtatcaacaaatgtgccatatggagcattcatagaatccccattccaaccaaaatcattagagttagttgaatcgatttggctaccatctttatcagactgtggagcttgataaccatttgaccatgtatcaagcttaaatcccagagcattttgcaagccaccaatacccaagttgccaccagcattaccaatatctgtggtattaccgttatgaaaagcaaagccaataccgtcagctccattaggattggatcctaaattaaccttaccagttaaagtaaaactagtattcatatcaattttactcttgagagagaaatttccaactttattatattcatctggtgtaatagtcacaataccagtattttgatcataagtggctgatccgtttaatgaaaagtaagcaagaaaattatccttagtaacatgtgttagatcttctttatcagtcgccaaagccttacttgtacgtaattgttgcaataatgtgttgtaagatatcttagttacagtttggcgtgttttagcactagtcgtttcggccttcactgcactgctactacttgcactggtcgtttcagcctttgctgcactgctactacttgcactagtcgtttcagcctttgctgcactgctactacttgcactagtcgtttcagcctttgctgcactgctactacttgcactggtcgtttcagcctttgctgtactgctactacttgcactggtcgtttcagcctttgctgcactgctactacttgcactagtcgtttcggcctttgctgcactgctactacttgcactggtcgtttcggcctttgctgcactgctactacttgcactagtcgtttcggcctttgctgcactgctactacttgcactagtcgtttcggcctttgctgcactgctactacttgcactagtcgtttcggcctttgctgcactgctactacttgcactagtcgtttcggcctttgctgcactgctactacttgtactggttgcatcggtcctcactgcactgcttgaggtgctggtggctgtcacatcagctgacactggccggctggtaactagcatccctaatcccagcgaaaataatgaaatccccatgacagcccaattcttaccgcatttatataatttataatgcgttttagtctctccaaaataattatttcttaacataaaagaacctacctttctcactttttttagataaaatgttgtcattaaaatcccggtttattaaggctattgggtcttttcaattagaatagaaactactaatatcctctaaattgggcctatctttcgcacgaaagtatctaaaaaacgtgccacattcccatcgctaattaagcgacattaataaacaacatttataataacacacttaaaatttaaattgaattacatacaagtaaacattgcaaaactagttcagcaattatacataggccttcactatttagctattaatatttaaattttcaaattaaaacaacaaataagaatcaattgtgtttttttaatttgagcttgttgctgtaacttgtgcgtaaaggcttgtttagttttgatgccaatcatcaaaaagatcatgcttgttggtttcaaaatctaaatccataaagccagcctcctacccaaaatcaatgtgatccagcatcgtttcagtactagcctggtctcagcctaaataagctaaagtcatcgcttcactggaatgattgaggaaattcacgactaagccaatattataatttgattgcgtgtagacgcgataagccccggttttgctcatggtatgggaacctagataatcaattcctaacagatcgccaaccttgctcatgattttgtagaactgtttttccgtgatatggcgttctgggtggtgaatggaagaaaaaagccattcagaatctagcttatgatcaagcagccattgacggtacgataagagctctgtttgaactggtacaaggtattaggtttacccgttttcgatcgtgaatgaacacgttttgtttaatagaaccgtctggattaaaaatatcggtctgttttaacctcataacgtcactcactctcagcagtgtagctttgccaacttgaaaaatcgtatagttacgccggccggctttaaagttattgagtaacgtatcttgaacctctttaagtacgtttgaatctttaataggtaagacaacttgttacataagtcataatctcctttgacgatataatagtttataattgacgtacgttatcatgtacgcttataatattagataagttgaggagggaaaacatatggaaaaaattattaacccaactacagcacgaacaaacctattttcacttatcaaaaacgctaatcgggactcccaacctgttattattgcaggatctaatgacagccgtagtgccgttttgattggaaaaaaagactatgatgcattacaggaaaccatgaacttaatgatgaatggtcagattcaagccaccttcagccgtaaagatgatgaatcagttgatttagacgaaatgatcaaagaaattgatcatgagtaatcgttggaaagtaaaaataaaatcatcagctaaaggtgatttaaaaaaagtattaagaagcccattacgtcagtcatttgaagaaatacaaaatgtattggaatctgatccatataaaccaatacagtcatttgaaaaattaacaccacctgcggctggttactattctcgaaggataaatggacagcatcgcgtcgtttataccattgataaagtaactagaatagtcgaaatctattcatgttgggcccattatgaaagtggtggtcttgaaatgagtggtaaatctaattccagaaaaaactagcaacttaacatgcatcataaatcaaatattataataaataacccccaatatccacattatagatattgggggttattttagcagggctttcgaggggcgatttggagattatagtccctaatatagggacaaagcttatttgaaagtttttctcaaacacatcatgtattttagactgtgccactattattctctgttatagggtttaatttagaaagttctaatgaacatatctaacttaaatagattgtgagacacgaaatggccattaaggtataccctattggccatttttgatccattatcaatggctttctaaattatcaagttcttagacttattaaaaattgttaaataagtttaattgttcaaagcaagcaaaatctctatttgttaaggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaacccggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccttcataatatattgctggacacactgctcaacatctaaacgcatttcagttcctccaaatttgagatgcgtttattttaccgtaaaaaaatgttggaaaaccgacattttctaatcggtattttccaacattttacaaccgttgctgacatactagtttgcaaaaacaaattatagtaatttagtgaatcattcccgatataacgactatgaaacatcatcattgctgcgagtagtgatatagcacaaattaagtatgggagttttcgtttttgcattgtagaaaaagcattaaataggattgcaacaactatttcaaatgcaactaatcctaaaaattgcaatattccttctacggtcataactctgtctcctaatttctaaatagtttctttctcacaactccaaacccttctcgaattaggttaattcctattaaccatcctaataccgcatagctaacgatcacaatcattccaatagcaaaaaatgataggtacgtactatacgggataatttcctttgccacaaggacgatcacaagtacaacaatcgaacaaacactgatccgtattaattgtggaatggttgagcgcattgaaaaacctgggataaatctcttaattcttggaaaaagtaacatcgatacaataaacattgaaatacttgttgctaatgatattcctcctacaccaatgaaacgggatagagtgatgcacaagaaaatattcaaagcaactgctattgcaccattcatcataggaattcgagtattctgaaatgcataaaaaatacgaactaaattggagcgtagcgcctgaaataagaaacctgctgcataaccataaacaacatgagacgtactaataatttctgaatgcttaaaacttccacgaccatacaaaatttcaacaatatttgtcccacaaacaaagcacataatcattaccggtataatcactacaaacaacgcctcgattgagcgcttaaaattttcaccgacacgattatattgtttttcagcaacccaagtagcatagtgagagaaaagaactgttgatacagacgaaacaattagcgtcgttaccatttcattgatcgatgcaccaaatgaaagaaatgatgcgtttcctgcccctaatcctgttgaaacttgcttatcaacaatatcattaattgcataaatcgcattcccaattaataacggaaaggacaatcgaagtaagctattaattgcttttttctctgatgttatgtgctttttaaacttgaacttattacgtgcattccatgtaatttgaaggcattgagctaccccagcaagtaggaatgcgtaagctagaatttcaataccaaaggtctttgcaccaattatcgctgcaatacatataaaaagattttgaaagaaactttgcccttgacctggcaaaaatatcttatctgtctctaaagttacgttaacgattagggtataacacgtaaagacaaacatcggtgacattagccaaatatagtgcgagattagctttaattgactacctgtataagatggggctaaaaatttggcgaacaatggcgatcctaacccaaaaattaaagcaacaactactgaaagtggaacaaatatccttattactgcattaattagattatttgaggatgttcgcccgttctctatcaaacgatctgaatgcatagatagtagtgatatcgaaatcgctgaaaaaatcaccgaacacaaggacgttatcacacctgttgcaataaaataaacatcagtttgtgaattcgcaccaaaaaatgcagcaataatagactgctttagaacgcctaggatttttatgattattactgcaattgtgatttgcagtgtcgatcccacaatactcctcgacttactcttctgcgccaaaacaaatcctcctaataaagcaacaataggggaacaaaaaattgctccccaatatcaaaaatctaagtctatatcctatctacatgcaagccgtagacgcatccatcattttaccgcaattttgaggcgagaagattctcgtaaatctttgtcatattctttcccgcatcttcagctgaataaacgctctgcttaagttattctgtatatgccctcctttgtggaatccgttctatcgcttttttaaaagctttttcccattcttcgataggttcatccaacgatacgtacttcaccagatcgatatacaccaattcatctgtaacgctagctgataaaatcgacggtaaccccattgcttgagcttcaactccagttagtggtaaaccttcaaaaagcgagggtaaaaagaatacatccattgcctggtaaagatcttgaacatcatccctacttcctaggaaagatacaaccttacctaaccccttcttttctacgtacgctctcagttgatcatctagttcaccactaccaatccaccaataaacaatactaggattactttggtgtaccttctcaattacatcaattgcgaaataaggttttttttgtatagatgtccgaccaacagtccctacaacaacctttggcataatgaagttcctttcagatttcacaaagtcctatttagaatttacaccaattatacggacataaccttttctgagttatagaccgggatcaccactgacaattttttatttttcatttctctaacaatgttttcccttctaacctagtttcataatttttggaactacaaccactaatcgaattattcaagcatgttaccaaaaaaagacttgggtggcgtttttcatcaaaatacttctaaggacgacaattttagcactttgaaatcatggtcagtcctttattcgtactctcttttggaatgtgctattgaatctcacagtccaaccattagttgattccgtattcttacgatatatatatattatgggtgaaggaaatagcagattcccgctgaatcccaatccccttatagacagtaaactccttaccgtgatcgctagtaattgatttggttaacccatataacttttcgctgatttccaaaattgtctttattatctctttactatcatgacctattagccaccgaataatcatcaattagggatccgcccctggttttcctggaagaacagtatcaacatcgaagtgactactttcttaaaagaaagttggttttagccggacgttagctgataacctaaccgcttttcctgccctcaatgtgccaacttctcagtgccgccttcttgggattgatcggcatcgtaatgccccctaagtcgccgccttagatcatagttgataattttacaatctaccatttatctgaccactatattaaaaatgttactttccctctatataagggtaaagaatttgtatccacataggtcacctctcagaattgataacataaaaataaacaaagataatgacattaatattttaatatcggtgcttttacctttcgtattctgagcataaagtaaaggatatagcaatcccatacttataaaagtagctagaaacgttagtcgcattggtaccgcatagcttacaggaagtgtcattatacaaataagtaagacaatatccgaatacctaacaagagatctattaatagttatacaaccatgttttattaactcatgactctttatgtttacatatccaacttgcatcatagctattatactaataaccaattgccatacatttcgatactctgtctcattgtcaatatagccgctcccgtactgtaaacttcccgctatagttccccaaaaagctataactaaagctacccctactagaatcctaaatattttttttaaagcgctactttgccctataaccaagaatataaatctaattattatcaatagagccccaattgagtgtagaaacagagcgaatacatacaagggagcatgtagaacaaggctcttaccttccacagtttccatatatatacaatagaacacgattgtagttgctaatgctgatcttattccagaaatcgtctgtaaaaagattgcaccattagccattaaataaagtagtataacccacctatttttagcctcaactttgtttattttatattcatttcctacaatacggaacagtaatccaaatactatacaacacgtcaccgtttgcaacatgtttatattcccagtctgctgtaatatccacgaatacagaacccacgttggttggctattacttatggcatacttaacgaccccatcccaacttaaatatgaccaatacgctatatactgccttactctatatagatcagccgttatatatggattgtaaaaatatgcaaaggaacataaaatgataaggtatattaatagtacagtttttattcgccttgctcttacacagctgataatacagcatataattatcaacgataatgtatacactgctaaactaactccacgttcgtataaaaacataattaactccagtcatattaatgcttcacttttttagtttcaagaaacgtttgtaaatatttgtcatattctttcccgcatcttcagctgaataaacgctccgcttaagttctcctgtatacgccctcctttgtggaatccgttcgatcgcttttttaaaagctttttcccattcttcgataggttcatccaacgatacgtacttcaccagattggtatacaccaattcatctgtaacgctagctgataaaatcgacggtaaccccattgcttgagcttcaactccagttagtggtaaaccttcaaaaagcgagggtaaaaagaatacatccattgcctggtaaagatcttgaacatcatccctacttcctaggaaagatacaaccttacctaatcccttcttttctacgtacgctctcagttgatcatctagttcaccactaccaatccaccaataaacaatactaggattactttggtgtaccttctcaattacatcaattgcgaaataagggtttttttgtatagatgtccgaccaacagtccctacaacaaccttatcgtcaacgccaagctcttttctgattttatctctcttgactttatcaaaggtgttcgtttctggtgagattacatttggaataaccgtaaacttagctttcccaaatagtgcttccccagctagttggccgcatgcacaataatctgtaatttcccttttcaataatggcaataggagcttcgtaatccgttccttcttgatgcttgtgcttaatttcgtgttgtgactatgcaaaatccgtacaggaactccacatttcttagcagcaagcatcattggaatggatttaatcaagttgttatcacaaacaacatcgtaatccccatctcgtaatatctttttgcattcctgataatgatggtaaacgttatttattggcggcagaatgaatatttttgaaccccgttctataatttcatcatagtacggtgatggaacatcattcattagagcaaaatccatttgaactttcgtaggatctagttttctaaaataagacattacaaagctagttacaccattagaagcacgtaggttccctataaacatcaatactttcatatcactactttttctctatttcgttattattttttaacgtttgctcatctactgacgcattggaaattcgccgacgccttacctcatttagcttctccattacactaggggagatacatccgcctaataaaagtccctttcgatacatagacacctcattagagagtaatatttttaaaatattactgcgaatgtactttagccaacggcggtaatcagttcgataatcactaaccacatgattttgaatcaatttagtaattgcaccaatcgaatacatagagcgatgtaagattagcatcatttcaatgctcttagtcttacgtgggagatcccgttcaatttcattaattgacttttcgccattataaacgctatcaatcttaaatttagatgttgctgacgcgtaattgttccgacggtaataatagcccttatagtttgtaactacgacatgattagcggcttcagccgccatgataataaagtaaagaccttcgccataaaatagatctgtccgaaacttcaatgatttttctactaaaaaatctcgccgatataccttattccaacagccaacaattacacgtggggatagcaacaaacttaccgccttttctggagcatacactttatcttcagtttgatccaaaggtttctcatcattcttcgtaaaacaatctagagccagtccgaaatccgaatgggttttctctaccatattaaccatatactccagaaaagtcggagcgataaaatcatcaccatcaataaaagtaatatattttccttgagcgttgtcaatccccgtattccgtgcggtactaactcctgcgttttcttgatgaatcaccttaaccgcttcatattgttgcgctaagtgatccgcgatctctccagtattatctggtgagccatcatcaacaataatcacttcataaccagttaaagtttgtgcaacaactgattcaacacaaaacgctaagtatttttcgactttatatgcaggaataatcactgaaattagcggcgtgttactttgattgttactcatctttcccctcaatcgcattagtaaggtattttaatgaatctttctgtttctgtgcaagaagttgatttacatgatcaaaattaatttccttttgaactacatcatcaatttcactgaagctttcaattgtgcgatcactcaagtcaaattcacctaataaagaggtaagtttattacggttactctctcggaccttaactactagcttggagttacaaataatagaaataacagaaccatggaaggtatcagttattacaaatgcagcattcttaatccatcctagtaattggagtggggaaacattaatattcctgtcagcccatttatggtaaaaacctattgagtatacctttaaccccttttctttagcataagccttaatagcatcgacttcttcaggatcattcattcgactatcataagcataaaccgctatataacccttctcatttggaatatactgttgttgctcttcggggtaaccatataacagtaccgggtcgattactaagggaacctttttatcggaaagatccctaactacgttttgcgaattacggtcccgaacgctaattgcattaaactgagctaatcccttttgaatgtcttctgttcgctctttttgtttaatgtcttccgtagtggatggcccaaacgatgccgcataactaactaagcgattgctcttaattccgtaaccatacatgacagcattataaccaatctcaacactaaagacctcatcgctaccaactaccgttacgtcaccattaaattcagaatagggaaccattgaaaagtttgcttcccgaaattcttttaggatttgcgatttttttacgttgtataaaacgttaccgattcccttttcttttaagaaaccaatgtagtatgggatgctacctaaactaatttgatatttctttgcttttccagctagaacgtagtcataattacgttcaaaggatacaaatgacacctcatgtcccattttctgtaataccgaatttagcgcatttgcttgtaacactgccccgtggttatgcacaccgtagtaagttaaaattccaattttcatatctcattatccctattttctttggctttctaatgattcggctacttgtgtagtacctttttataaattaactcccgtaactttgctggcacgataacatttgccaccattacaaagtcccccgttaactcttcgcgcctagaaacaagctttcctttgtacaacattcgacgtaatttaaaaatttgctttaagttagcccactccccgcgtcgtccgtacattcctgtatcaacacgcatatgaactaatacttccgataagtttaatactggatacttcccattcgcttgatagttaccaacatcaaggatagctttcttatttaacattaccgaggggtggttaaatgggcttctccattttacaaattggtagatgtcttcttgacccgttggtaccaatcttttaccagtaatatgattaacttcacccgtgaattcatcaatttgaccacccacaattgctaactgtggattattaacaactgcctttaattgtaattcaaatcgatttggcacagaaacatcatccgaatccattcgagcaatccaatcgtagcggcaccgttctacccctttttgtaatgcggcgcctaatccccgattggaggtcaattttaagagttcatatttgtttgaaaaacgcttttgatgctcttcgattactttgtccagttcggctgttaaggggccatcttctaccaaaacaatttggtctgggatcaccgtctgttcttcaatactcattagtgcttgatctaaaaataccggtttttctttctggtaaaccgacattaagactgaaaaatccggtagttcgtcgttacacataaaattactccattttttaaccaaaaaatcaggaaatcccctaccctcatagcatgcttcctgttttagcccttgattctattttccgtcatggacgccgcgtctggtaaaaacggctaacacagtttccatcaaaattgaaaaatctccccgtaaggttacattactggcgtattcaccgtcgtaatctgctttttgggtatccgttacttcatcgcgaccccggacctgagccaagcccgttattccgggtgccaaactttcagctccattggcgtgacgaagccgcaagaccttttcctcctttggaatcagcggtcgtggcccaataaaggacatttcacccttcaccacgttcaccaactgcggcaattcatccaaactggtttttcgcattaaccgaccgctccgcgtgatgtagctcagtgcggtgtcaaattccgatgttgccatttggtggggtgcatcatcactcatggaacggaacttataaatcgtaaaccgtttcccattgcggccgacccgttcctgcttaaacagcactggtccctttgagtctagcttaatccaaattgccggtcaagtccaaaatgttggtgtaaattaaattccgcgaatttatcatttcacaagcttaagcataccggcttcttctgaattgtcatctttttcaatcccgtggtaaacggtcatgtttaagtaccgtggaccagggtggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggaccgcagcggcagtttcataatcttcaaagaccggcactggataaacacattcctttttgagggaagcgtgaaaagattccattggcgcattatcatacggacaacccttacggctgtatgagtggcggatatgtagctcagttaaacgttgattgtaatcatcgctggtatactgtgatcctaaatccgtatggataatcaggtccccagtaatggttcaatttttaaccgcgctttcaagggtctttaagactaaatcagtagccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagttgggacgctgttcaaccttggttttggaagccgaagccgctttccatttattgacggtaacggaatggatatccagttccttcatgagccgggaaatccgtcttgggctgcaccgacgctgcagtggttgaagttccagattcaattcatggtggatcttcataacaccgtatcgctgcttaaattccgcaaagatccgcagaatccgttgtttcaagtccgcatcttcggcccggcgttttgaaggtttgggggatcgataacgataatactgagctctggaaacaccgaggattcggcacatcttggttacctggtggtgatggctttcttggtgaatataatcaaagatattggttacttctgcgcaaggaagcccagggctttttttaggatttcgttctcctcagacagcgaagccagtcgcttttccatcgctttgatttcgtctggcgatttaccggattgagttttggcctggccctggatccacttatgaactgttgaatagccaatgccatattctctggccagttgggcagctgattcgccttgcttatataggttgataatgttttgtttaaattctttgtcgtaacgagttggcatgtaaaaattccttccttttgagagacgatttattcattataccctctcttaaaagttgtctcaggaatcagcttacatccaaaaatgatagagactatcatggaaccctctatcaaaaggtaaatgaaaaatcttgaattgcagtcaataggtgagatcgcttcttggacttcaattgtaaatcaaccaatgtgatgttatatttgatgatagattgtatttaatagcgttagttaaaacgtgttttaatcttgttaattttggagagtgaatgatggatcaaacagtaagctttgatttttttatccggcttgtccgtaattactggcgtgcaattgtcagttttacggtggtgggattgatagttgccgcagggttgaccttctttgtaattacacccaagtaccaatcaagtgtccagattttggttaaccgtaaaaatactaatgccgctactgagtatgttgggcagcaggctgacgttcagatgattacgacctacaaggaattaattgctggacaagtggttttaaaaccaactcagcaacaattaagtgagcgttatggtattgagcgctcactgaacacattgaaaagtgaagttagcgtgacaagtacgaccaactcacaagttttctcgattgcagttactgacactgatgcaaaagctagtgcgacaattgccaatcagattgctcgtagttttaagaaccaagtgcaaaagattattaaagttaacaacgtcacgattgttgctccagccgaaacgccaaatggtgcggtatcaccgaaaaaacctcttaatatgttggttgggttagttgcaggattgttactaggatttgcttatgcagcgattcgggtgctcacggatcgccgcgttcacgacgctgatttcttaactgatgaattaggattgactagtttaggcttggttaaccatcaacatcactattcaatgaagaaacaggccttgaatctgaatggtggctatcatacgcataatgatcgaacatcgtcacaagcgatgaaacgagtttaggagggtgttagatgtttaaacgtaaagaacagaatataacgactacggcaccaattaatctcacaacgattaatgaacccacgtcggtcattactgagcagattaaaacaattcgaaccaatatcaattttgcggctactgacaaaaatttacgaactttaatggtgacttcagcgatgattggtgaaggtaagtccacggtaagttgcaacttggcggtggaatatgctaaggaagggatgcaagttttattggtcgatgctgatttacggcgaccaacgattcacacgacgttcgggcttaaaaatcataagggattaagttcatggttggctaatcaaatggacaatgtgaatgatgcaatccatcccgttattggtaacctatttgtgatgacgagtggtcctaagccaccgaatcccgcggaactgttagaaagcaacaaaatgacggaattcttaacttcggcaactcgcaagttagatctagtaatcgttgatgcagcaccaatcctgcctgttactgattcacaattactggctaataaagtcgatggcacagttttagtggttcgtcagggcgtggcgcaaaaagcagcggttcgtgatgcggttaattcgttgaaaaaatcgcaagccaatattctgggcgcggtactgaatgatgttcgcgatggttcacaccatggttattacggctatagtagcagttatggatattacagtgatgaagataaataatttagttgacttacattgccacatcttaccggctattgatgatggctcaccttccttagaagcgtcgttagaattggcacggcaggcggtggctgacgggattcgctatattttagcgacaccacaccatatggatcggcactatctcaatcatgccggtgatgtggcggcagcggttaagacatttcaagcagagctagatgcaaatgatattccgttaaccatttttcctggtcaggaggtacatctgaatggtcagttgatggaaaatattgatgatttgttggggatagataccagtagacactatttactattggaacttccccacgagatggtaccaagttacttggatgagatgatttttcaattgtcttgtgaggggattaccccggtcattgcacaccctgaacggaatgctcaaattattgccgaaccgcagcgattatacaagttggccgaggatggggtcttggcacaggttacggccacgagtttagttggcacttttggggaacgagtacagcgaactgcaaaagaattcgttaagtgtggtttggttcaagtggtcgcatcagatgcgcatacgctgaaaaatcggggctttgctatgaccaaggcttatgacgtattaaatgagatgaattcggaatatcctgaacgttttgcaaccaacgctcgggatttgttgaatggtgaacagattgatattggcggaattgagatgccacgaaaacagcgaaagcactggttgttttaaaagaaggagggagttaaatgaaagcattagtaactggaggagcgggatttattggttcccaccttgtggatcacttggtatcagaaggtttggacgttgtcgtagttgataacttgtccatgggggacttacataatattaagcatcaggatgaagtcactatttatgttgaagatgtccgcaacgaaaaattcatgcaacaattgctacaggaagaacagcctgattatatttactttttagcagctgttgctagtgtggccgattcgattgaacgtccagctgaaacccattcagtgaatcaaactgcagtattcaatatgttggaatatattcggaagactaatttaccaattaaacagttcctatttacgtcttcggcagcggtttatggtaatctgccagaattgcctaagaaagaagactcacgagtcgatccactatcaccatatgcgattgataagtatgctacggaacgttttgtactagcatatggtgaactttatgatttaccaactgtctgtgtgcgtttcttcaatgtttatggccctggtcaaaatcccagttcgccatattcaggggtgctgtcgatcttgaccgattgtctcaataacaagaagccatttaccttgtacggagatgggagtcagacacgagattttgtgtatgttgaagatgttatccaagcattatggttgataactaagagtgatacggagcatgaagtctttaatattgccaatggtaatgaagccagcttaaataccattatcgaaacgtatgaaaaagttgcggggacctcattgcaggtcaagatggcgccagggcgtaaaggggaagtaaaacgttcagtggccaacatcggtaagttaattaagttgggatacacgacgaagtggtcgttagaagcgggcttgagcaaatattgggaaggggcgcaacgacgtgaagcaagtcaaaatcaatgaaacagttaaagttggtcatgtacaaccacaaatggattatcgctttccagctatgattggaaagccagttacgggctggaaactgtttgtaaaacggatttttgatcttactgttgggttaatcgggacggttttgagctcgccaattgtcctagtgtttgccattcttgtaaagctgacttctaaagggccagcattttataagcaagagcgggttggcctcatggggaagagttttaatgtaattaagctgcggtctatgtatcaggatgctgaagcacgaaccggtgcggtttgggcccaaaagaatgatccgcgaattacgcccattggtcggtttatgcgaaaaactcgagtagatgaattaccacaattttggaatgtattaaaaggtgatatgagtttggtaggaccgcgaccagaacggccagtactgacagaggaatttagtcggcaatttccaaattttcctagaaggttacgtattattcctggtattacagggtatgcacaaatcaatggtggctacgatattacgccagatgagaaatgtaagttggataattactatattgaacatttttcggtttggttcgatattaagatgttattaggaacagtcaaagttgtgtttactggggatggtgcgcgttaatggtagaagattattcaggactgatgtcaatttatagtaaggaaagtcctgatttattacgaaacgcttttgatagtatattagctcagacaattcttccaaaagagtttgtgtgtgtattggatggaccaattggcctaaaattgacggaagtggtgaagtggtttaaatccgaatgtattaatcggaatattaaaatagttttcgtgaaaaatcccgtgaactgtggtttaggaatctcacttgcagagggacttagagcatgtagttacgagtatatcggacgtttcgattcggacgatttaaataatcctgaacgtatggaagttatgcttaattatatgaatgaggataaaaaccaggatattgcggtcgttggaagtcagattgctgaatttagtgatagtcctcaaagacttattggaagaagaaaagtcccaataagtttcaatgaagtagcccagaaagtgtttttaaggaatcctttaaatcatatgactgttgtttttagaaaatcaattattttagctgttgatggttacaaagatatgccaggttttgaagattattatctatggatgagacttatagataatggatacaaaattacaaatgttcctgacacgctagtttatgcacatgttgatgggaatacatatgcccgtagaggtgggataggatacttacgtaaggaattaaaatttcaatattctgtgtattcgcaaaatattatcggaacacctacttttgtaagaaatatttttgttagaggaatcgtgagactgcttccgcaaaaatggttagctggattatataaactattgcattaatcagcttacatccaattggcccgatccatattcgcctgaacagcgtggaacaaatgagaatacaaatggattaatccgggaatattttcccaagcgaaaagatattgataattatacagaacaggacgttgaacactgccaaaagcagttaaatcaacgtcctcgcaaagtgttaaactatgaaaccccatatgaagtattttttgacaaaccgttgcacttagtttgacaattcgccgtaagtaaaaaccaacaactggttaatttattaaggcaaattctataattaatccgaacagaaattaaaaagcccaaagcaatcacttacaatggtagtagctaattccaaccaatatagggagtgattactttgggtacatctactttatcacgttttcaacgtggcgcactagcacaactggtcaatgaggggaataaatcttaccaagtaatggctgacgccttaggcgtcgccaaagctacgattagctatgagttggaccgggttaaaccttatgatccagaattagctcagcaagatgcagatcgcaaaaggcggaattgcggtcgtcgttcgatgctgacggcagcattagcgactttaattaccaatcacttacgattaacctggtcaccagaaaccattgcggccgcttataacttgagcactgcgtcaatttataattggcttaatcgtggctggctccccttcaaattgactgatctacccaatcggaatgtccgccagcaccgagtgagcgaaaatcgtgggaaattttacaagtgggacttccatcgaacaacggccaacaactgttaatcaacggttagcttttggtcattgggaagtagatacggtgctttctagccgaagtgagtcacgatcatgtctggttacattcgtagaacgtaagacccgacttctatgggccatcaaagcccctaatagaacggctaaggctctaaacaccgcctttggcaaagtttatgggggccttcggtccccaagtaaaatccattactgttgatcatggtaaagagtttgccaattatcaggccttagaacaggattatcagatcaaagtttatttttgccatccatattcaccatgggagcgaggttccaatgaatattttaatagacggttacgctggttcttcccgaaaaagaccaattttagctaagtaacgactgatgagatcctagcagcacttgaactaattaatcaacgaccattaaaaatacatcatcaacagactgccattgaaagattccgggcttgttcggattaaacttgtgccggttgtaaaagtgaacctaaatgacgggttcaccaaccggaacaacgtgaagggcggtagggtaaggtctaatcaaaatcaaaacttaatttatggccgtcaagctttaacttggcgtcaaacgactttccttttttgctcttgaacccctttagtttgctggtttcccccttagtgattaaggctttgatcgcagttttaccgagggttttactgctccatttcttgggcagggtaaagtcctcgccttgcttgggtttcacaatgtaaaacttttgtttatttatgacagttacttgtggtgtttctaagaacacctcggcaactttttgcgcttgctgttggtgattgatttgttgtttaatggctgcactgccagttaattgtgttgggacatcagcgatcaatttcactacgaacctcttaatttggctcaaaaagttatccggggtgcgttcttcggtactgatttgctgtaacgcttgctcccatttagccgtcatttctggactagttagcaagggttcgagttcgaccgcttcacataatgttatcccggcttcactgacgtgcagcttatttttttcagtgacgagatagccgcgtttttttaatatttccagtacatttgcccgggtcgcacttgtcccaatgccttgcacgtctttgagaatcgcctgggctgcttcatcatcaagcgttttaccggccgtcttcatggccgtaatcagggtaccttcggtaaatggtaccggcggggtcgtttctttttacggcgtttgcagattttcttggacttgatcgccttggtgaacgagcggtaaggttgctgcttcttgctgttcggctttgtgatcatcaaataaagcttgccaaccttgcttagttgggaccttaccggttgctttaaaattggcgtcaccaacttgggtaataatggtggttccctcgtactcgtacggatcagcaaacatcgctaacgtcgttcttaaaaccaagtcatagacttgttgctgtaatttaggtaaggcagctaattgatctttcgtcgggacgattttagttatgataatggcgtagtgttcttcaaccttctttccattaacatagcgcttattcggggcggtattggttaaagcgactggcttagagactaaacccagatacttcgtcagattaaccactaaatactcaaattcttcatcagtgatataagcacaatcggtgcggggatagctaaggaacttggcttcgtataaactctgaatggccgccaaagtctggctggcactggcatgataccgtttattcatggcactttgcagactagatagcgagaatagttgcggactaacacgttttttcccttgctttgggacgtccttgattaaaccggcctgtgagcctttctgaacgtgtttagcttgcataaatgttactagccctgtttcgtctttaaatcgctgataggggtctaattttgcgacaaattttttctgattagcaagaatttccgcatttagttcaaaatagggttccggcttaaagtttttgattgcctggtctctttgatagaccatatacaaggttggcgtctgcacgcgaccaattgagtacaccccgcgtactcctttttgtcttaacaacaaagtatataagggactaccattcataccaattaaccagtcactaatttgacgggtttgagcttctttataagccaaatagtctttgtgccaatcaccaagatttttaaagccggtaataatcgcgtctttttctaggctattcaaccaaaggcgcttaatcgttttcgacttaacatcaatatgcgcttggttcatgatcgaccacgcgatatttgacccttctcgaccactatcggtggccacaataatggtatcggctttcgttaacaggtctttaacgaccttgaattgggcttttttactagctgacacttcaaacttgtatttgtcggggaaaatcggtaaattagataaggcccattgttgatatttctgatcatatttatccggtgtggctagttcaactaaatgtccgagaccatacgtcacaagcgtattttcgggcaaaacagggtcactaaccgtatagtaaccctgtttttttgtgctcttttgaaaggcttggacgtatgaacgggcttgactgggtttttcagctaagataacagtggtcatgttcgttcactccttgtgattaagcttctgttctaattctgttttgccttgttcagccgcttttaaccaggtttaacggtgcattttttattccgattacaagtgcatgccaccatcctcatgccgattacgagtttgatgttgccgttgctttttcgccatttcccactcagtctcctttaaaccttgcgcctgtctttgtcgttggtaatcttcatcacgagcatatagaacagtcatgattgcgtcactaaaggccgtttttaagtagtagtttggactaactggcttataatttaacggttgataatgccccatatttgcttttctatactggtcgtccttggcttgttgcgcttttaactgcttttggattttctcaatctgactgtttttaatcatcggatcggctttgcattcacccaaaaagagttgtttagtgccgtcatgctttaaaacccgttgtaagtgatgattctctagctgatctaagctaagctgtcccgataaataagctagtccttgttgatgttcctgagtagtgaaaaccctcggtgggttttcctgccactgtgcgattgtttcaaccttgcatggctttaaagctggatcatagtacatcacggctgtataggcctgttcctgtttaatcattgggagttcattaaaattgccattaggaaaggcttttcttaaaacttcctggtattgggtttgaatgacttgtttaactgccattattgttcgcaaatctttgactgctcgagtaatcgtttgctgctcagttggtgaatacttttctagtagtcctttatcgacgtgttctaggctttctaagctatcagagtggatcattagcgtatatttcagatcgattttggcctctttttcttgttgcattaataacttaaaacaaacgtatggccgcttggtaaaggtcaataattgctgggtcaataaatcatcacgaatattcattaaacgttcgtttaattcactgcctttgaaaactgtttgctcgctttcggtttccttaattaattctcgtctttcagcttgtgtggtttgttcaaaattaagctctggataaagttttttcgtagtacgatcgaccactttatttaagagttcatctgccttttttaatgagctttcttgttggttaattgtcaataattctttagtcacatcttcaccaactgcatgtttaattaaggtactgttcttccaattaaatagcatgcgccgcttatcatctaaactttccaaactaatataagttttcagttcgtggcttaactctttgaccacttttttctcgttaaacgagaagtgtttacttaggctatccaagtggcctcgattaactactttctcctgcatatttttatagccagctttggacttacgatagttcttaacttgttgattaaatgcctttctttcatgccgttttctattgattccctcgtgttgcattggtgtgtcagctattccctgttccacaaatgatttttcactgatctgatcaggaatgtttttttgctctaaaacctgattgacactaactgcccaattatgacgccattcagttactttttcttttttatcccaatcaaccaaccaaatttttcggtttctcacattccctgcaggggtcttagttttattaccatgactatctaaaatgtattcggtttttgttttctgtccccaagtaccatcggggttaaatgggcgattggttaacatcacatgagcgtgcggattatctgggtggtcgcgatgaattgccacgtcggctaccatgccctcatcaacaaagttttcttgcacatattttgtcagtaattctttctgttcggattcacttaattctaccggtaaagccacgttaaactcttttgcataccgtgagtttgatttacgatctttcttttcaacttcattccacaactgctctcgatcactcgcccattcagatgaattttttggcgtcaaaataaagctttctggcatgatcgatcgggcataaaaatagtggcgaccttccttatcatcaaatagcttttcaccacttctataagcggcgctggcaatggcactgcgtcctttaccagcactaatattactaaaactcatatgaaatattgccatgtcggtcaccacctttctttgggtttatgggtttgactttgttgtcgccatcggcgacttctaatacaggttttaattgttttagtacaacgtcatcaaatatgacgtgtaagtgcgcattgacctcgtttcactcggtcttctgattctcttaactttaatttagtgtatgccttccgcttcgctatttcaactttcatactttgacttaacgttctctgtatgatatagtgtcggtgattatttttaatacgactgggggaatcattatgtctcaaagtaacttagaaaaacaagaagctaaattaaaagcccttaatcaaaaaattaaggacgaaaaaaataagattgaacaacggctaggtaaacaaatcatcagtcaagccaatttagattatgctaatttatctaatgacaatatcaagtccttatccaaaaaagtatccgagtttttaaaggaaaagtccgtagatcattagtcataggagatggggaattccatgcctaatcaatatgaaaaactaattgaacaacaagcgcgtttaaaacaaaaaattgagcgggaagattttaaattacgacaatctaaatactatgaaaatcggcaagaccgcaaagcacgttctcgccgattaattcaaaaaggggctttattagaaaagtactttcaagctaataacctatcggtcgaacaaaccgaagaacttttaaaaacatttgctgactatgttaacgcccataaaccggataaattaaaaaacgatcaacctaataactaggccgatcgttttttggcttaatttctggattgtgtttagcaaagtcttttaactgtttttgaattctttgtgtaagctctgctttactttctttgtgcttccttttacttgatcgctgttgaattatcttttgacccttacctcttctttttgattttaggtcaagcgtaaaatctgaaattttattttgatctagcttacttaaatgaccgatttctttaaagtttaaactggctttgggaaagctataaatattaccaagatcgacccaggaaggtttcttcaacccagcggattgccaatcttgaatcggataatattgttgcttgatataagccgacttcttttcatactgactagtaattttaaaagcctcgaccttctgttctgatacccgacgaattaaaactggccgagacttgccaccgttagtttctacaaaactaacgtataggctgactaagtcattagtcctcatctggatcgttgagccaatcagcgacctctttagcgtctttgaactcggtgactggtgtcccttcggtcgcctttaaaaagcgtaaattagctctttcttcttcgcttaaagacgcattaaaaggtaaagcaccattagcaacaatccgcttgtaaaacatattaatggccgtggttggatttaagcccaattcgcttaaaattgcttcggtatcatcggccaaatctttatcaatcttgacttggacccgtttcttttccttaactgccatgattgtctcatctcctttcttttactactaccattatactaccttttgagtaccttatcaatagataaagccttggcctcaaatcacttgagcttggcgttgatctaaaggctgaactttttggttagcctggttagctctgacactgatttaaaagcccctattcttctgcttaagccatttaaatctagcttaagcataaaaggttagtaaaccttaaaagcgcttagaaaggattttgtagccttttagggctagtagtacaactcactgttatcgttgtcggccgatttttcttcttcggggtgtttggccgcgtattctctagccgcttgtttattccaccaaacaccaaatagattttgcatggtgccgtacaggtagttttccacgttcttgatgtgcctctcattgcttcttagggcgttaaagtaacgtctcaaggctttagttattaaaaatttaagttcttcgtcgtccagtgggattatgacgccaatatctttatgatccttctcaactcggtacttagcatttaagatgataccaacgaagcgacgcatctgttgcggggtacggcaccaaaaactaagcagtattcatcatgttacagcacccaagtaaaagctacgaagataaaaacattcatcctcaaaatatgtaacctagaaaaaagaccgccagtgttaaaccgggagccttttttagtataccaatttctacttcacataatgcacagtattcaaagctaaactttgtgaagtctagttaggcctagtgtatcagtgtttatagacaactcactgtttgatttagccagtttagctgagtttgtgaaattagcttaaactgtcctaattaactggcttgtgattatcttgtgattattatttatttattcaatttagttgacttattggtttacccctgctgtaatgcgagggagtgaagtggttgagtgcagagttgtaccctagtcagacggtcaaaattaaaatgactatctagctagagtgcaactcacctgttgtaacgctcggtcgttcgggcatcgcttggacaatcagttgcggtattgctaccaaccactagtatcaacctacattctcggttaaacccattaaaaaacgccctaatggacgctgatagcacgtatttagttttgttcggttaccagctactagtggtcaccatgcctaagcatcgttttaccacccgggccgttaatggtcgccctcaccattcatcaccagcctgattgtctaaggccttatgtgatataaccggttgttattgaagtcgcaccggtaaacgtgtccccttaatatttatactctagcttgtcccctagaatggtccgcgagaagcaattgaatgtcaagacttgcaattttagagtctagaccgtacaattaatacatggttatttgtggttcccgcgaagtagaaggtcgcggggcttcttttgtatattcagttattttaggtctggcttaattgctaggccttttttaatacaaggatattgtagctccttattaggcgagtgtcaacacttttttaatttagtctacaaatctacatatctatttatctacatgtatttatgtatactcgcatacaaatagataataggaaatagaatgtatttattgctgtttaaacaagcttttatggtagctaaactgtctacatatctacatatctacatgtactcttgtattttagtctacatatatttttgtatatttgtatatttatctacatgtagatgtttgataatctgtgctatatgaattataatagtgagattaagggggctagcagaatggtaaaagttattacgtttggaaatttcaaaggtggaactggaaaaacaactaacagctgcatgatttcatacagactagctaaacaaggatacaaggtactactagcagatttagacccgcaggctaatgcaaccgcattatatctaaagactaaacaagttcaaaataatgaggttgttaaatttgataatactttaatgaatgcaatcagcaatgatgatataagtactattgttactaagattcgtgacaatctttatttgttgcccagttttgcagactttacatcatatccaattttcttagaaaagaagtacccgaacacagatgaccaatataaacgagctaaacacttttcaaatttgctagttaaaattaaagatgactacgattacattatcattgatacgccaccgactgttagtgtatacactgactcagcgttaatggcctcagacagcgttataattgtgcttcaaactcaagaacggtcgtatgtaggtgctgaggcctttatatcttacctgcaagagcttgtctctaattatgacgcagatttcaacattgcaggaatactaccggttctgctaaagaacaacagccaggttgatcagtcgatactagaacaagccgaggctgagtttgacaaggataatatttttaaaaatgttgttaaaaatatggaacggctaaaacgttatgacattattggcattgttgatccagatttaaaaacacaaaaacatgatatgcatgatatgcgagtagatgcgctatataagaaaattacaaatgaatttgttgaaagggttggtaaagatgagtaaagacctgctcaagaaaagccttaactcagatgttactcaagttccgaaacctagcaatatattttcgcgggacatgaaagtgaaagcaaacactaaaaagtctaagcctaaaactactacaattagatgctcagttgagacagccgatatggtaaatgcattatccgcagtgcttaattttaaaagtgtggatgagatgcttgaacacacaattaatagcacactagaaggtttaacaaatgaggaacgtgctgaatatcgaacggtgaagaagatatatactagcagacgctcaaaataactagcaataatcacaatttagatggaatcgttatactattaatagtggagagataaatgggaggctaacgcatgaatgaagaagataaaaagaaagaagaacaacaaaggttggccgataaaaagtttgaagacttcatccaaggaatttacgatactaacaaggagccttctaatgaggactggctagataatgttgccagtgcaatggtccctaatgaggccgataaagagaagagataatgaaaaatgttcggaagtttattacaattattaggactatcaagatggtatcatcacgaacaacacgctgataggtcgaatgctcgtaaagctagtggtcagtcagccttctaatacgatgaccttaaaggattacgtaagttggcattctggctatttgtattcagcatattcctaaattggggcatgttcggtgctattatgctaattgcatggctagcaatgtgggcaataagtataatcttttagttttgttgtaaattaaaagctatctcaaattactgaggtagcttttttatggttgatataattattgtattgggtctcccggtgcatgaattttacctgtagaactaactccccaagcaagtccgtcatcgttgacaaagctccaagaaccattgtcgccttcacttgcgttcaagtcatctagtgatgtacctccaaaatcatcatccccattgccttgagatttagcccagtttcttagaatctgcttggcttgggattcagttaaggctgtagaactagttgtagactgagtagaagaagactctgatgaactagagttttcgactgatgagctactttcagaagaatctatgtcatcattagtagagtttagtatcctttactatatataataaggaggtctctaatgctagtttttctgtcaacatcattcataccatccaatgataagatgtggtcacgagttggcataaataaaaatcaacaattcccgccattggcaatagatttaggatgacgttcccttaattttgaatggtgtccatggtcttagttaaatttttcttgtttctgcccaattgattcaattcagtaactatgacaacaccaccttaacaaatcataatttggataatagtatgttccatttgaaagctaagccttataattagcatagggttaatagctctaatcaaaatacccacaaaaggcctgctcaactaacaattgagtaggccttttgtagtacaaattaatccttatcacaactaacctcaatagcacaacaggtataaataatgcttaaaattcctaaataaatttctctcacaactgtttaataaagcggcaatccccgtcgtacgtgattaattaaacattcaattcttaaaacacctatttttaaatcgacttaaaccttcgctgttgcgtgcgtttactaatccccgtctttcgttcaatcatcttataagtcatgccttgttttcgcagctcataagcaaatctgatctgttcatcagaatacgttttcggtcgtccttcccgaaatgacggatcatgttgcttggcatacaatttaccttcttgcgtgcgcgtgacaatcatatcgcgttcaaactgcgcaaaagcactaaatattgtaaagactaattggccagtcggcgtattatcaattaagcccatattcaaaatattaactttgacattttctttaaacaacttttggataatggctaacgcctcgcgcgtgttccgcgcaaaccgatccaacttagtgacaatcaaagtatcgcctgtttttagaacgcgcaacagtttttgaaactccggtcgttcagtagttgtgccggtaaacttttcctgaaagattttttctgctcctgccaattttagcaactcaatttgatttgctaatttttgatcagtggtactgacccgcgcatagccatatttcatctttttatctccttacttatgtcattaagtaatgacacggttctaaccctttaattatacagcatcaaaaaacaggccacaactgttaagttgtgacctggttcattccatttaaacactttaattatcacatattcaaaacgtcaaaaaatttgtatctaaatatatctaagcttttttaatggtgagaaactttgccacttgcaatgctcgattaattacttaggtatacaaaatgattattgtcacgagactaaaataatcttaatgtttaaattttcttcacttcaataaaagaccggcctgctcaaacccaagggttttaacggaccgatctttatttacattaaggcatctttacttactttgaaaaacttttaatttatcttagccagttgttgtgacaaagtttccacttgtttagccaacttctccagattgtgactctggtcgaaagtttttaagttcgcttgcacttgccgaaaaaccttttggactctttcttggccattaacagtcaaagttagccgaacaattcgtcgatcatttggattcacttgtgattgaattaaattatcttgaatcaatcgccaagtattcctggaaattagtgtgcgcgtaaccatgaatgcatcagctaattcactagcagtagcttgcccatgttgctcaagatagactaatattccccactcacgcattgaaaattcagttttggccagtccttgcactaacatctggtatgcctgtttctgaatagcttgcagggttgttaagctctcaaactggttcttaatttgctgatgatttagcatataatatcatcctattctttgcgctgccgcttagtcattccgaagagtcctaacaaactactcatggctaatagtaataagccactcagcgtcatgtgttgttgatcagtttcatcagtttgaggcaaccgttgatccacaaaattagtagccgctgcttgaccagcctgaaccggcttaacaggtgtcgttgattggcttgggttaatcggctttattggcgtcgttggttgacttgggttaactggttttgctggcatcgttggttgacttgggttaactggttttgctggcgtcgttggttgacttggattaactggttttgttggcatcgttggttgacttgggttaactggttttgctggcgtcgttggttgacttggattaactggttttgttggcgcatccttggtataaaccaccgtgaagtcaagatcac

SEQ ID NO: 8 - DNA, 7184 bp, Lactobacillus plantarum
aaccgttaaactttttcgttccgattcttgaaccccacgttgaatattaaaaccatgctgttgcaaataagctggtaattgatcttgaacatctcgcaaagccgtgcgattaaatactcgtttagcagataatttatgttcatcatcaaaagggacaatccccatatgcatatgtggcgtactctcatcaagatgaacaattgcataacgaatattttcttcaccaaatttttcagcaaaataattcctcgccgtttcaaaatatttgcgggtatcagccgccgtcaaatcggcaaagaaattgctatcactcgaaataatccattcattgactaaaacggcatcttttctgaccgctcgctgactggttttatgctcgttaatataagcctcaatatccgttttgaaatggttagtccgaccagcaactaaatcataatttaagtcagaacggtcaacgtcaatatcagtatttttgtgatgtcgcgttcggcgttgatcatgattacccaagccaactaaattatcagcttttaatttctgcatattagccactaaataactcatttcaccactccattccaaacagctaaatttggttagagcatagcatagaattcggaaaacctccatgcaaggtatagcccaatatactttaccttgtaaagtgtgggctctgcgaggccggttttgccgctggcaaaaaaataatcaaaggtcgcttttgctcccaatgattatttaaaacaataataccttaacaatgttcatcaaaaataaaatttctcaaaacatgtaaaagtcttctctgaatttctacaggttcagtttttcttttctcaaattctctaatataatcatcgctttgatcagcactcatatttctaagattattaccagatcctcgagtagctatcaattcatagtaagcgaacaacgattgcacgattttatccactatttcaaaaatactatttggaattgcaagagttccttcaacaaaatttctcaaagctagtaaatcactattcaaatcaggaatagaatctttaccggcacattctccaattttattatgaagtgctccagctttctcaaaaaaactatttataaattcctgcaaaacaacaaacttattagaattatcagtataatttgtaactccagaaatgaattttacatcagaattactaatattattaccgttaaaattaccagaagaagtattagaacaattatcttgactggtctgattgcttcttttcatgcttctcaccttcactattatcaacattgacactagaattatcgatattattaccattgaaatttcccttaatatttttcgaactgttaatagtctttttatttcctgtaaaaaagttaaaagcacccttaatcattcccttaaacaatccctttaaggcattgaaaaatgaagccaaagcaatcacctcccccctcacttataatatagacaataaatcattaaacaaaataattcttacgctgataatcccatttagcaacaatctcacgcaccacttgatcaaccttttgatcatcactatccgtattaatcaaatcaccattttcaacgtcttccaattgcaactgtttgcgaatttctttcagtaacccaccataactaatttggcgggaaccagccaaagcttgttccagatcgtcaaccacctgtaagtcttgttctggattattcgtcaaaatatctttagactttacctgatatttagccgtttcttgagcactggccaataaagaatttttatggcgattcacattcggtttaactgcctcaacattcacaatcggaacataagtcaatttcattgcccgttgccaataaccagtccattctgactgtgaaatataattatcagatcctttaaaataaagactcttcacaaataataaaacatgcatatgatggtgatacatcggctgatctgcttcatgattaacggtcacttcagtcgaacgcacatagcctaacaaattcttagctggctttttataacgcattaaatcacgaacagctcgccccatttgtcgtagctcactctttaattgcttaccagttgtattctcaaccgtcagcgttagaaataagaaccgaccagtttttcgttgtttaaccgcttcttctaaaatttgagttaactgattagactgcttcattgcccgccgccaattgcataacgggcataaacgggaatgacaaaaccaagtctgcgctagtttcttatgaccttgttcatcttccacaaagcgcaaaacttccccacattctttaacccgatgagctttcttataatgcaatatttgtaaatagtcaccatactgcaagttctctaacttgcgctcccgccacggccgaactttccctgactttgaccgatcaaccaagactttttcattagccaaaataaaaactcctctcatctggccacgtgagaagagttaatctgttatgtacttgcttcacttaaatcagtcagaaggcttgacggcaaagggttcaagctttaaactatgtctagtaaatccaaatacgatttttacaagattaactcacgcgttcgaggtcggcaaactttcgaagctcacgtgggttttttttatatttattttataccacaataatacgcctaaagccaatcatgtcaacgttttgttacacatttggaaaagtccgttgtttctaatagtatcaagataagaagaaactggtcaaaatcgaccagtttctaagccctcgggcgctgacgccccgaacccagtccaagctgtgccagcttgaccgcataaatgagcgggagctcccgctcaaactcaccccgcactcgccgtgaggcaggaaagcaaagtttaggaaactttggctttcagccaattcagtgtctgggtttggttagtcaatcaactccttaaagcctcaaaaagggactaactgctaaagcagtaagtccctttaattcgatttaccgttgactgacggccattaaacagctccaatactcatcagcggttaaattaaagccatagaccaaattcaaaggcttggaccatctaattcatcatgttgtccctctgaacgctcttgtggcctctgaggggcttttttagacggttcttttaatccagctcgctctagccactcatttggtaagccaacacctaatttgcgctgtaagaaccggtcaacgctccgaacaattccttgtaacgcatccactaatttttggagcttctcatttttcttgcttaactcataattattgtctttaacttcaagcagttgataattcaggctttgattatcaagttttaaacggttctgttgttgattataaatatcactgacagctgctcgagattctaagtcatgaagatcactttttctaacaaccactttatccttgcttaaaaaagtaggtttgctctcaatttcctgctgatcacgaggtttaagttcagcaaggcgtcttctggcatcttcaagttcagcttgtatttctcgttttttaagcgtcgcctttttcaaatcttcacgcatagctttatattctggaaccgttaaactttttcgttccgattcttgaaccccacgttgaatattaaaaccatgctgttgcaaataagctggtaattgatcttgaacatctcgcaaagccgtgcgattaaatactcgtttagcagataatttatgttcatcatcaaaagggacaatccccatatgcatatgtggcgtactctcatcaagatgaacaattgcataacgaatattttcttcaccaaatttttcagcaaaataattcctcgccgtttcaaaatatttgcgggtatcagccgccgtcaaatcggcaaagaaattgctatcactcgaaataatccattcattgactaaaacggcatcttttctgaccgctcgctgactggttttatgctcgttaatataagcctcaatatccgttttgaaatggttagtccgaccagcaactaaatcataatttaagtcagaacggtcaacgtcaatatcagtatttttgtgatgtcgcgttcggcgttgatcatgattacccaagccaactaaattatcagcttttaatttctgcatattagccactaaataactcatttcaccactccattccaaacagctaaatttggttagagcatagcatagaattcggaaaacctccatgcaaggtatagcccaatatactttaccttgtaaagtgtgggctctgcgaggccggttttgccgctggcaaaaaaataatcaaaggtcgcttttgctcccaatgattatttaaaacaataataccttaacaatgttcatcaaaaataaaatttctcaaaacatgtaaaagtcttctctgaatttctacaggttcagtttttcttttctcaaattctctaatataatcatcgctttgatcagcactcatatttctaagattattaccagatcctcgagtagctatcaattcatagtaagcgaacaacgattgcacgattttatccactatttcaaaaatactatttggaattgcaagagttccttcaacaaaatttctcaaagctagtaaatcactattcaaatcaggaatagaatctttaccggcacattctccaattttattatgaagtgctccagctttctcaaaaaaactatttataaattcctgcaaaacaacaaacttattagaattatcagtataatttgtaactccagaaatgaattttacatcagaattactaatattattaccgttaaaattaccagaagaagtattagaacaattatcttgactggtctgattgcttcttttcatgcttctcaccttcactattatcaacattgacactagaattatcgatattattaccattgaaatttcccttaatatttttcgaactgttaatagtctttttatttcctgtaaaaaagttaaaagcacccttaatcattcccttaaacaatccctttaaggcattgaaaaatgaagccaaagcaatcacctcccccctcacttataatatagacaataaatcattaaacaaaataattcttacgctgataatcccatttagcaacaatctcacgcaccacttgatcaaccttttgatcatcactatccgtattaatcaaatcaccattttcaacgtcttccaattgcaactgtttgcgaatttctttcagtaacccaccataactaatttggcgggaaccagccaaagcttgttccagatcgtcaaccacctgtaagtcttgttctggattattcgtcaaaatatctttagactttacctgatatttagccgtttcttgagcactggccaataaagaatttttatggcgattcacattcggtttaactgcctcaacattcacaatcggaacataagtcaatttcattgcccgttgccaataaccagtccattctgactgtgaaatataattatcagatcctttaaaataaagactcttcacaaataataaaacatgcatatgatggtgatacatcggctgatctgcttcatgattaacggtcacttcagtcgaacgcacatagcctaacaaattcttagctggctttttataacgcattaaatcacgaacagctcgccccatttgtcgtagctcactctttaattgcttaccagttgtattctcaaccgtcagcgttagaaataagaaccgaccagtttttcgttgtttaaccgcttcttctaaaatttgagttaactgattagactgcttcattgcccgccgccaattgcataacgggcataaacgggaatgacaaaaccaagtctgcgctagtttcttatgaccttgttcatcttccacaaagcgcaaaacttccccacattctttaacccgatgagctttcttataatgcaatatttgtaaatagtcaccatactgcaagttctctaacttgcgctcccgccacggccgaactttccctgactttgaccgatcaaccaagactttttcattagccaaaataaaaactcctctcatctggccacgtgagaagagttaatctgttatgtacttgcttcacttaaatcagtcagaaggcttgacggcaaagggttcaagctttaaactatgtctagtaaatccaaatacgatttttacaagattaactcacgcgttcgaggtcggcaaactttcgaagctcacgtgggttttttttatatttattttataccacaataatacgcctaaagccaatcatgtcaacgttttgttacacatttggaaaagtccgttgtttctaatagtatcaagataagaagaaactggtcaaaatcgaccagtttctaagccctcgggcgctgacgccccgaacccagtccaagctgtgccagcttgaccgcataaatgagcgggagctcccgctcaaactcaccccgcactcgccgtgaggcaggaaagcaaagtttaggaaactttggctttcagccaattcagtgtctgggtttggttagtcaatcaactccttaaagcctcaaaaagggactaactgctaaagcagtaagtccctttaattcgatttaccgttgactgacggccattaaacagctccaatactcatcagcggttaaattaaagccatagaccaaattcaaaggcttggaccatctaattcatcatgttgtccctctgaacgctcttgtggcctctgaggggcttttttagacggttcttttaatccagctcgctctagccactcatttggtaagccaacacctaatttgcgctgtaagaaccggtcaacgctccgaacaattccttgtaacgcatccactaatttttggagcttctcatttttcttgcttaactcataattattgtctttaacttcaagcagttgataattcaggctttgattatcaagttttaaacggttctgttgttgattataaatatcactgacagctgctcgagattctaagtcatgaagatcactttttctaacaaccactttatccttgcttaaaaaagtaggtttgctctcaatttcctgctgatcacgaggtttaagttcagcaaggcgtcttctggcatcttcaagttcagcttgtatttctcgttttttaagcgtcgcctttttcaaatcttcacgcatagctttatattctgg
